(12) United States Patent
Morris et al.

(10) Patent No.: US 7,816,076 B2
(45) Date of Patent: Oct. 19, 2010

(54) THERAPEUTIC TARGETS IN CANCER

(75) Inventors: David W. Morris, Davis, CA (US); Marc S. Malandro, Davis, CA (US)

(73) Assignee: Sagres Discovery, Inc., Emeryville, CA (US)

( * ) Notice: Subject to any disclaimer, the term of this patent is extended or adjusted under 35 U.S.C. 154(b) by 212 days.

(21) Appl. No.: 11/257,477

(22) Filed: Oct. 24, 2005

(65) Prior Publication Data

US 2007/0212351 A1    Sep. 13, 2007

Related U.S. Application Data

(62) Division of application No. 10/367,094, filed on Feb. 14, 2003, now abandoned.

(51) Int. Cl.
  C12Q 1/00   (2006.01)
  C12Q 1/68   (2006.01)
  G01N 33/574 (2006.01)

(52) U.S. Cl. .................. 435/4; 435/7.23; 435/6; 436/64

(58) Field of Classification Search .............. None
See application file for complete search history.

(56) References Cited

U.S. PATENT DOCUMENTS

| | | |
|---|---|---|
| 4,179,337 A | 12/1979 | Davis et al. |
| 4,301,144 A | 11/1981 | Iwashita et al. |
| 4,469,863 A | 9/1984 | Ts'o et al. |
| 4,496,689 A | 1/1985 | Mitra |
| 4,640,835 A | 2/1987 | Shimizu et al. |
| 4,670,417 A | 6/1987 | Iwasaki et al. |
| 4,683,195 A | 7/1987 | Mullis et al. |
| 4,683,202 A | 7/1987 | Mullis et al. |
| 4,753,894 A | 6/1988 | Frankel et al. |
| 4,777,127 A | 10/1988 | Suni et al. |
| 4,791,192 A | 12/1988 | Nakagawa et al. |
| 4,816,567 A | 3/1989 | Cabilly et al. |
| 4,892,890 A | 1/1990 | Damani |
| 4,938,948 A | 7/1990 | Ring et al. |
| 4,956,453 A | 9/1990 | Bjorn et al. |
| 4,959,314 A | 9/1990 | Mark et al. |
| 5,034,506 A | 7/1991 | Summerton et al. |
| 5,124,246 A | 6/1992 | Urdea et al. |
| 5,149,655 A | 9/1992 | McCabe et al. |
| 5,206,152 A | 4/1993 | Sukhatme |
| 5,216,141 A | 6/1993 | Benner |
| 5,219,740 A | 6/1993 | Miller et al. |
| 5,235,033 A | 8/1993 | Summerton et al. |
| 5,359,100 A | 10/1994 | Urdea et al. |
| 5,384,261 A | 1/1995 | Winkler et al. |
| 5,386,023 A | 1/1995 | Sanghvi et al. |
| 5,419,966 A | 5/1995 | Reed et al. |
| 5,422,120 A | 6/1995 | Kim |
| 5,445,934 A | 8/1995 | Fodor et al. |
| 5,470,967 A | 11/1995 | Huie et al. |
| 5,530,101 A | 6/1996 | Queen et al. |
| 5,545,730 A | 8/1996 | Urdea et al. |
| 5,545,806 A | 8/1996 | Lonberg et al. |
| 5,545,807 A | 8/1996 | Surani et al. |
| 5,569,825 A | 10/1996 | Lonberg et al. |
| 5,571,670 A | 11/1996 | Urdea et al. |
| 5,580,731 A | 12/1996 | Chang et al. |
| 5,580,859 A | 12/1996 | Felgner et al. |
| 5,585,089 A | 12/1996 | Queen et al. |
| 5,591,584 A | 1/1997 | Chang et al. |
| 5,594,117 A | 1/1997 | Urdea et al. |
| 5,594,118 A | 1/1997 | Urdea et al. |
| 5,597,909 A | 1/1997 | Urdea et al. |
| 5,602,240 A | 2/1997 | De Mesmaeker et al. |
| 5,624,802 A | 4/1997 | Urdea et al. |
| 5,625,126 A | 4/1997 | Lonberg et al. |
| 5,633,425 A | 5/1997 | Lonberg et al. |
| 5,635,352 A | 6/1997 | Urdea et al. |
| 5,637,684 A | 6/1997 | Cook et al. |
| 5,644,048 A | 7/1997 | Yau |

(Continued)

FOREIGN PATENT DOCUMENTS

EP    0 225 807    6/1987

(Continued)

OTHER PUBLICATIONS

GenBank Accession No. AF357835. Sasaki, S.et al. (2000). "Cloning and Expression of Human B Cell-Specific Transcription Factor BACH$_2$ Mapped to Chromosome 6q15," *Oncogene* 19:3739-3749 (Abstract Only).
Sasaki, S.et al. (2000). "Cloning and Expression of Human B Cell-Specific Transcription Factor BACH$_2$ Mapped to Chromosome 6q15," *Oncogene* 19:3739-3749.
Allen, J. D. and Berns, A. (1996). "Complementation Tagging of Cooperating Oncogenes in Knockout Mice," *Cancer Biology* 7:299-306.
Altschul, S. F. and Gish, W. (1996). "Local Alignment Statistics" In *Methods in Enzymology* vol. 266, Academic Press, Inc., pp. 460-480.
Altschul, S. F. et al. (1990). "Basic Local Alignment Search Tool," *J. Mol. Biol.* 215:403-410.
Aplin, J. D. and Wriston, Jr., J. C. (1981). "Preparation, Properties, and Applications of Carbohydrate Conjugates of Proteins and Lipids," *CRC Crit. Rev. Biochem.* pp. 259-306.

(Continued)

*Primary Examiner*—Larry R. Helms
*Assistant Examiner*—Lei Yao
(74) *Attorney, Agent, or Firm*—David Gay; Astrid Spain

(57) ABSTRACT

The present invention relates to novel sequences for use in detection, diagnosis and treatment of cancers, especially lymphomas. The invention provides cancer-associated (CA) polynucleotide sequences whose expression is associated with cancer. The present invention provides CA polypeptides associated with cancer that are present on the cell surface and present novel therapeutic targets against cancer. The present invention further provides diagnostic compositions and methods for the detection of cancer. The present invention provides monoclonal and polyclonal antibodies specific for the CA polypeptides. The present invention also provides diagnostic tools and therapeutic compositions and methods for screening, prevention and treatment of cancer.

10 Claims, 4 Drawing Sheets

U.S. PATENT DOCUMENTS

| | | | |
|---|---|---|---|
| 5,654,337 A | 8/1997 | Roentsch et al. | |
| 5,661,016 A | 8/1997 | Lonberg et al. | |
| 5,681,697 A | 10/1997 | Urdea et al. | |
| 5,681,702 A | 10/1997 | Collins et al. | |
| 5,700,637 A | 12/1997 | Southern | |
| 5,714,331 A | 2/1998 | Buchardt et al. | |
| 5,759,776 A | 6/1998 | Smith et al. | |
| 5,776,683 A | 7/1998 | Smith et al. | |
| 5,814,482 A | 9/1998 | Dubensky, Jr. et al. | |
| 5,837,832 A | 11/1998 | Chee et al. | |
| 5,928,870 A | 7/1999 | Lapidus et al. | |
| 5,939,598 A | 8/1999 | Kucherlapati et al. | |
| 6,074,825 A | 6/2000 | Rundell et al. | |
| 6,107,475 A | 8/2000 | Godiska et al. | |
| 6,153,441 A | 11/2000 | Appelbaum et al. | |
| 7,038,032 B2* | 5/2006 | Sheppard et al. | 536/23.5 |
| 2002/0132237 A1 | 9/2002 | Algate et al. | |
| 2003/0027253 A1* | 2/2003 | Presnell et al. | 435/69.1 |
| 2003/0158100 A1* | 8/2003 | Renauld et al. | 514/12 |

FOREIGN PATENT DOCUMENTS

| | | |
|---|---|---|
| EP | 0 345 242 | 12/1989 |
| EP | 0 519 596 | 12/1992 |
| EP | 0 524 968 | 2/1993 |
| EP | 1 365 034 A2 | 11/2003 |
| EP | 1 365 034 A3 | 11/2003 |
| GB | 2 200 651 | 8/1988 |
| WO | WO 87/05330 | 9/1987 |
| WO | WO 90/07936 | 7/1990 |
| WO | WO 90/10448 | 9/1990 |
| WO | WO 90/11092 | 10/1990 |
| WO | WO 91/02805 | 3/1991 |
| WO | WO 91/04753 | 4/1991 |
| WO | WO 91/10741 | 7/1991 |
| WO | WO 91/14445 | 10/1991 |
| WO | WO 92/02526 | 2/1992 |
| WO | WO 92/11022 | 7/1992 |
| WO | WO 92/11033 | 7/1992 |
| WO | WO 93/03769 | 3/1993 |
| WO | WO 93/10218 | 5/1993 |
| WO | WO 93/11230 | 6/1993 |
| WO | WO 93/14778 | 8/1993 |
| WO | WO 93/19191 | 9/1993 |
| WO | WO 93/22443 | 11/1993 |
| WO | WO 93/25234 | 12/1993 |
| WO | WO 93/25698 | 12/1993 |
| WO | WO 94/02602 | 2/1994 |
| WO | WO 94/03622 | 2/1994 |
| WO | WO 94/12649 | 6/1994 |
| WO | WO 94/23697 | 10/1994 |
| WO | WO 94/28938 | 12/1994 |
| WO | WO 95/00655 | 1/1995 |
| WO | WO 95/07994 | 3/1995 |
| WO | WO 95/11984 | 5/1995 |
| WO | WO 95/13796 | 5/1995 |
| WO | WO 95/25116 | 9/1995 |
| WO | WO 95/30763 | 11/1995 |
| WO | WO 95/35505 | 12/1995 |
| WO | WO 96/17072 | 6/1996 |
| WO | WO 96/30498 | 10/1996 |
| WO | WO 96/33735 | 10/1996 |
| WO | WO 97/27212 | 7/1997 |
| WO | WO 97/27213 | 7/1997 |
| WO | WO 97/42338 | 11/1997 |
| WO | WO 98/24893 | 6/1998 |
| WO | WO9846743 | 10/1998 |
| WO | WO 01/43869 | 6/2001 |
| WO | WO-01/72830 A2 | 10/2001 |
| WO | WO-01/72830 A3 | 10/2001 |
| WO | WO0177327 | 10/2001 |
| WO | WO 01/94629 | 12/2001 |
| WO | WO 02/22660 | 3/2002 |
| WO | WO-02/057497 A2 | 7/2002 |
| WO | WO-02/057497 A3 | 7/2002 |
| WO | WO02083070 * | 10/2002 |
| WO | WO 03/008583 | 1/2003 |
| WO | WO03000928 | 1/2003 |
| WO | WO-03/039443 A2 | 5/2003 |
| WO | WO-03/039443 A3 | 5/2003 |
| WO | WO03042661 * | 5/2003 |
| WO | WO 03/057146 | 7/2003 |
| WO | WO03073826 | 9/2003 |
| WO | WO2004048938 | 6/2004 |
| WO | WO2004060270 | 7/2004 |
| WO | WO2004076682 | 9/2004 |

OTHER PUBLICATIONS

Apweiler, R et al. (2000). "InterPro—an Integrated Documentation Resource for Protein Families, Domains and Functional Sites," *Bioinformalics* 16(12):1145-1150.

Arenberg, D. A. et al. (2001). "The Murine CC Chemokine, 6C-Kine, Inhibits Tumor Growth and Angiogenesis in a Human Lung Cancer SCID Mouse Model," *Cancer Immunol. Immunother* 49:587-592.

Ausubel, F. M. et al., eds. (1992). *Short Protocols in Molecular Biology*. Greene Publishing Associated and John Wiley & Sons, pp. iii-xviii (Table of Contents Only).

Ashburner, M. et al. (2000). "The Gene Ontology: Tool for the Unification of Biology," The Gene Ontology Consortium, *Nature Genetics* 25:25-29.

Bai, J. et al. (1999). "Sequence Comparison of JSRV with Endogenous Proviruses: Envelope Genotypes and a Novel ORF With Similarity to a G-Protein-Coupled Receptor," *Virology* 258:333-343.

Beaucage, S. L. and Iyer, R. P. (1993). "The Functionalization of Oligonucleotides Via Phosphoramidite Derivatives," *Tetrahedron* 49(10):1925-1963.

Berns, A. (Date unknown). "Table A: Retroviral Insertion Sties in EμMyc and EμMyc; Piml$^{-/-;}$ Piml 2$^{-/-}$Lymphomas$^a$," published in the advance online issue of *Nature Genetics*, 13 pages total.

Berns, A. (Date unknown). "Web Fig A," describing PIM protein actions, published in the advance online issue of the *Nature Genetics*, 1 page total.

Boerner, P. et al. (1991). "Production of Antigen-Specific Human Monoclonal Antibodies from in Vitro-Primed Human Splenocytes," *J. Immunol.* 147(1):86-95.

Bolli. M. et al. (1994). "α-Bicyclo-DNA: Synthesis, Characterization, DNA-Analogues with Restricted Conformational Flexibility in the Sugar-Phosphate Backbone," Chapter 7 *In Carbohydrate Modifications in Antisense Research*, ACS Symposium Series 580, Shanghvi, Y. S and Cook, P. D, eds, American Chemical Society, Washington, pp. 100-117.

Brill, W. et al. (1989). "Synthesis of Oligodeoxynucleoside Phosphoridithioates via Thioamidites," *J. Am. Chem. Soc.* 111:2321-2322.

Brondz, I. et al. (1991). "Multivariate Analyses of Fatty Acid Data from Whole-Cell Methanolysates of *Prevotella, Bacteroides* and *Porphyromonas* spp," *J. Gen. Microbiol.* 137:1445-1452.

Brower, V. (1998). "Naked DNA Vaccines Come of Age," *Nature Biotechnology* 16:1304-1305.

Brown, B. A et al. (1987). "Tumor-Specific Genetically Engineered Murine/Human Chimeric Monoclonal Antibody," *Cancer Res.* 47:3577-3583.

Campbell, A. M. (1984). "General Properties and Applications of Monoclonal Antibodies," Chapter 1 *In Monoclonal Antibody Technology: The Production and Characterization of Rodent and Human Hybridomas*, Burdon, R. H and van Knippenberg, P. H., eds, Elsevier, pp. 1-32.

Caplen, N. J. et al. (2001). "Specific Inhibition of Gne Expression by Small Double-Stranded RNA's in Invertebrate and Vertebrate Systems," *Proc. Natl. Acad. Sci. USA* 98:9742-9747.

Carlsson, C. et al. (1996). "Screening for Genetic Mutations," *Nature* 380:207 (1 page total).

Carpino, L. A. and Han, G. Y. (1972). "The 9-Fluorenylmethoxycarbonyl Amino-Protecting Group," *J. Org. Chem* 37(22):3404-3409.

Cesarone, C. et al. (1979). "Improved Microflurometricd DNA Determination in Biological Material Using 33258 Hoechst," *Anal. Biochem.* 100:188-197.

Chiou, H. C et al. (1994). "In Vivo Gene Therapy Via Receptor-Mediated DNA Delivery," *In Gene Therapeutics: Methods and Applications of Direct Gene Transfer*, Wolff, J. A., ed. Birkhauser, pp. 143-156.

Chothia, and Lesk, A. M. (1987). "Canonical Structures for the Hypervariable Regions of Immunoglobulins," *J. Mol. Biol.* 196:901-917.

Chou, P. Y. and Fasman, G. D. (1978). "Prediction of The Secondary Structure of Proteins From Their Amino Acid Sequence," In *Advances in Enzymology and Related Areas of Molecular Biology*, Meister, A. , ed. John Wiley, vol. 47, pp. 45-148.

Clarke, J. and Fersht, A. R. (1993). "Engineering Disulfide Bonds as Probes of the Folding Pathway of Barnase: Increasing the Stability of Proteins Against the Rate of Denaturation," *Biochemistry* 32(16):4322-4329.

Claverie, J. M. (1994). "Large-Scale Sequence Analysis," Chapter 36 in Automated DNA Sequencing and Analysis Techniques, Adams et al, eds. Academic Press, San Diego, pp. 267-279.

Claverie, J. M. (1996). "Effective Large Scale Sequence Similarity Searches," Computer Methods for Macromolecular Sequence Analysis, Doolittleed., Academic Press, *Meth. Enzymology* 266:212-227.

Cole, S.P.C., et al. (1985). "The EBV-Hybridoma Technique and Its Application to Human Lung Cancer," *In Monoclonal Antibodies and Cancer Therapy*, Reisfeld, R. A. and Sell, S., ed., Alan R. Liss, New York, p. 77-96 (Includes Table of Contents).

Connelly, S. et al. (1995). "In Vivo Gene Delivery and Expression of Physiological Levels of Functional Human Factor VIII in Mice," *Human Gene Therapy* 6:185-193.

Creighton, T. E., ed. (1983). "Posttranslational Covalent Modifications of Polypeptide Chains," Chapter 2.4 *In Proteins: Structure and Molecular Properties*. W. H. Freeman & Co., San Francisco pp. 78-86 (Includes Table of Contents).

Curiel, D. T. et al. (1992). "High-Efficiency Gene Transfer Mediated by Adenovirus Coupled to DNA-Polylysine Complexes," *Hum. Gene. Ther*. 3:147-154.

Database Genbank Accession No. U52152, Schoots et al. May 21, 2001 "Cloning of Four Inwardly Rectifying Potassium Channels from Human," located at <http://ncbi.nlm.nih.gov/PubMed>, 2 pages.

Database Genbank Accession No. AF275818, Yang et al. Jul. 23, 2000. "A Family of Novel PR-Domanin (PRDM) Genes as Candidate Tumor Supressors" located at <http://ncbi.nlm.nih.gov/PubMed/>, 2 pages.

David, G. S. and Reisfeld, R. A. (1974). "Protein Iodination with Solid State Lactoperoxidase," *Biochemistry* 13(5):1014-1021.

De Mesmaeker, A. et al. (1994). "Comparison of Rigid and Flexible Backbones in Antisense Oligonucleotides," *Bioorganic & Medicinal Chem. Lett.* 4(3):395-398.

De Mesmaeker, A. et al. (1994). "Novel Backbone Replacements for Oligonucleotides," Chapter 2 *In Carbohydrate Modifications in Antisense Research*, ACS Symposium Series 580, Shanghvi, Y. S and Cook, P. D, eds, American Chemical Society, Washington, pp. 24-39.

Delli Bovi, P. et al. (1986). "Presence of Chromosomal Abnormalities and Lack of AIDS—Associated Kaposi's Sarcoma, Retrovirus DNA Sequences in AIDS" *Cancer Res.* 46:6333-6338.

Dempcy, R. O. et al. (1995). "Synthesis of a Thymidyl Pentamer of Deoxyribonucleic Guanidine and Binding Studies with DNA Homopolynucleotides," *Proc. Natl Acad. Sci. USA* 92:6097-6101.

DeRisi, et al. (1996). "Use of a cDNA Microarray to Analyse Gene Expression Patterns in Human Cancer," *Nature Genetics* 14:457-460.

Desbois, C. et al. (1996). "Exclusion of *Int-6* from PML Nuclear Bodies by Binding to the HTLV-1 Tax Oncoprotein," *Science* 273:951-953.

Devereux et al. (1984). "A Comprehensive Set of Sequence Analysis Programs for the VAX," *Nuc. Acid. Res.* 12(1):387-395.

Doudney, K. et al. (2001). "Comparative Physical and Transcript Maps of~1 Mb around *looptail*, a Gene for Severe Neural Tube Defects on Distal Mouse Chromosome 1 and Human Chromosome 1q22-q23," *Genomics* 72(2):180-192.

Drmanac, R. et al. (1991). "An Algorithm for the DNA Sequence Generation from k-Tuple Word Contents of the Minimal Number of Random Fragments," *J. Biomol Struc & Dyn* 8(5):1085-1102.

Eckstein. F., ed. (1991). *Oligonucleotides and Analogues: A Practical Approach*, Oxford University Press, vii-xvii. (Table of Contents Only).

Edge, A. S. B. et al. (1981). "Deglycosylation of Glycoproteins by Trifluoromerathneusulfonic Acid," *Anal. Biochem.* 118:131-137.

Egholm, M. (1993). "PNA Hybridizes to Complementary Oligonucleotides Obeying the Watson-Crick Hydrogenbonding Rules," *Nature* 365:566-568.

Elgholm, M. et al. (1992). "Peptide Nucleic Acids (PNA). Oligonucleotide Analogues with an Achiral Peptide Backbone," *J. Am. Chem. Soc.* 114:1895-1897.

Emini, E. A. et al. (1985). "Induction of Hepatitis A Virus-Neutralizing Antibody by a Virus-Specific Synthetic Peptide," *J. Virol.* 55(3)836-839.

Erny, K. M. et al. (1996). "Involvement of the *Tpl-2lcot* Oncogene in MMTV Turmorigenesis," *Oncogene* 13:2015-2020.

Evan, G. I. et al. (1985). "Isolation of Monoclonal Antibodies Specific for Human c-myc Proto-Oncogene Product," *Biology* 5(12):3610-3616.

Fan, L. et al. (2000). "Cutting Edge: Ectopic Expression of the Chemokine TCA4/SLC is Sufficient to Trigger Lymphoid Neogenesis. "*J. Immunol.* 164(8):3955-3959.

Feinberg, A. P. (1983). "A Technique for Radiolabeling DNA Restriction Endonuclease Fragments to High Specific Activity," *Anal. Biochem* 132:6-13.

Feng, D. F. & Doolittle, R. F. (1987). "Progressive Sequence Alignment as a Prerequisite to Correct Phylogenetic Trees," *J. Mol. Evol.* 25:351-360.

Field, J. et al. (1988). "Purification of a RAS-Responsive Adenylyl Cyclase Complex from Saccharomyces Cerevisiae by Use of a Epitope Addition Method," *Mol. Cell. Biol.* 8(5):2159-2165.

Findeis, M. A. et al. (1993). "Targeted Delivery of DNA for Gene Therapy via Receptors," *Trends Biotechnol.* 11:202-205.

Fishwild, D. M.et al. (1996). "High-Avidity Human IgGk Monoclonal Antibodies from a Novel Strain of Minilocus Transgienic Mice," *Nature Biotechnology* 14:845-851.

Foster, S. A et al. (1991). "Herpes Simplex Virus-Specified DNA Polymerase is the Target for the Antiviral Action of 9-(2-Phosphonylmethoxyethyl)adenine," *J. Biol. Chem*. 266:238-244.

Gallahan, D. and Callahan, R. (1987). "Mammary Tumorigenesis in Feral Mice: Identification of a New *int* Locus in Mouse Mammary Tumor Virus (Czech II)-Induced Mammary Tumors," *J. Virol.* 61(1):66-74.

Gao, X. and Jeffs, W. P. (1994). "Unusual Conformation of a 3'-thioformacetal Linkage in a DNA Duplex," *J. Biomolecular NMR* 4:17-34.

Garnier, J. et al. (1978). "Analysis of the Accuracy and Implications of Simple Methods for Predicting the Secondary Structure of Globular Proteins," *J. Mol. Bio.* 120:97-120.

Germer, S. et al. (2000). "High-Throughput SNP Allele-Frequency Determination in Pooled DNA Samples by Kinetic PCR," *Genome Res.* 10:258-266.

Go, M. and Miyazawa, S. (1980). "Relationship Between Mutability, Polarity and Exteriority of Amino Acid Residues in Protein Evolution," *Int. J. Peptide Protein Res.* 15:211-224.

Goding, J. W. (1986). "Production of Monoclonal Antibodies," Chapter 3 *In Monoclonal Antibodies: Principles and Practice*, Academic Press, Inc. $2^{nd}$ edition, pp. 59-103.

Guo, Z. et al. (1994). "Direct Fluorescence Analysis of Genetic Polymorphisms by Hybridization with Oligonucleotide Arrays on Glass Supports," *Nucleic Acids Res.* 22(24):5456-5465.

Haerzebrouck, P. et al. (1993). "Stability Effects Associated with the Introduction of a Partital and a Complete $Ca^{2+}$—Binding Site Into Human Lysozyme," *Protein Eng*.6(6):643-649.

Hanahan, D. and Weinberg, R. A. (2000). "The Hallmarks of Cancer," *Cell* 100:57-70.

Hansen, G. M. et al. (2000). "Genetic Profile of Insertion Mutations in Mouse Leukemias and Lymphomas," *Genome Res.* 10(2):237-243.

Heid, C. A et al. (1996). "Real Time Quantitative PCR," *Genome Research* 6:986-994.

Herdewijn, P. et al. (1994). "Hexopyranosyl-Like Oligonucleotides," Chapter 6 *In Carbohydrate Modifications in Antisense Research*, Shanghvi, Y. S and Cook, P. D, eds, ACS Symposium Series 580, American Chemical Society, Washington, pp. 80-99.

Higgins, D. G. and Sharp, P. M. (1989). "Fast and Sensitive Multiple Sequence Alignments on a Microcomputer," *CABIOS* 5(2):151-153.

Hilgers, J. and Sluyser, M. , eds. (1981). *Mammary Tumors in the Mouse.* Elsevier/ North-Holland Biomedical Press, pp. xvii-xvi. (Table of Contents Only).

Hoogenboom, H. R. and Winter, G. (1992). "By-Passing Immunisation Human Antibodies from Synthetic Repertoires of Germline $V_H$ Gene Segments Rearranged in Vitro," *J. Mol. Biol.* 227:381-388.

Hopp, T. P. et al. (1988). "A Short Polypeptide Marker Sequence Useful for Recombinant Protein Identification and Purification," *Biotechnology* 6:1204-1210.

Horn, T. et al. (1996). "Oligonucleotides with Alternating Anionic and Cationic Phosphoramidate Linkages: Synthesis and Hybridization of Stereo-Uniform Isomers," *Tetrahedron Letters* 37(6):743-746.

Hunter, W. M. and Greenwood, F. C. (1962). "Preparation of Iodine-131 Labelled Human Growth Hormone of High Specific Activity," *Nature* 194:495-49.

Hwang, H. C. et al. (2002). "Identification of Oncognes Collaborating with $p27^{Kip1}$ Loss by Insertional Mutagenesis and High-Throughput Insertion Site Analysis," *Proc. Natl Acad. Sci. USA* 99(17):11293-11298 (Includes supporting information).

Jameson, B. A. and Wolf, H. (1988). "The Antigenic Index: A Novel Algorithm for Predicting Antigenic Determinants," *CABIOS* 4(1):181-186.

Jenkins, G. N. and Turner, N. J. (1995). "The Biosynthesis of Carbocyclic Nucleosides," *Chem. Soc. Rev.* pp. 169-176.

Jiang, G-L et al. (2000). "The Yin-Yang of PR-Domain Famiy Genes in Tumorigenesis," *Histol. Histopathol.* 15(1):109-117.

Jolly, D. (1994). "Viral Vector Systems for Gene Therapy," *Cancer Gene Therapy* 1:51-64.

Jones, P. T. et al. (1986). "Replacing the Complementarity-Determining Regions in a Human Antibody with Those from a Mouse," *Nature* 321:522-525.

Jonkers, J. and Berns, A. (1996). "Retroviral Insertional Mutagenesis as a Strategy to Identify Cancer Genes," *Biochim. Biophys. Acta* 1287:29-57.

Joosten, M. et al. (2000). "Phenotyping of Evi 1, Evi 11/Cb2, and Evi 12 Transformed Leukemias Isolated from a Novel Panel of Cas-Br-M Murine Leukemia Virus-Infected Mice,"*J. Virology* 268:308-318.

Jung, M. P. et al. (1994). "Hybridization of Alternating Cationic/ Anionic Oligonucleotides to RNA Segments," *Nucleosides & Nucleotides* 13(6&7):1597-1605.

Kabat, E. A. et al. (1991). "Tabulation and Analysis of Amino Acid and Nucleic Acid Sequences of Precursors, V-Regions, C-Regions, J-Chain, T-Cell Receptors for Antigen, T-Cell Surface Antigens, $\beta_2$-Microglobulins, Major Histocompatibility Antigens, Thy-1, Complement, C-Reactive Protein, Thymopoietin, Integrins, Post-gamma Globulin, $\alpha_2$-Macroglobulins, and Other Related Proteins," *In Sequences of Proteins of Immunological Interest*, US Dept. of Health and Human Services NIH Publication No. 91-3242 , Fifth edition, 11 pages (Table of Contents only).

Kaplitt, M. G. et al. (1994). "Long-Term Gene Expression and Phenotypic Correction Using Adeno-Associated Virus Vectors in the Mammalian Brain," *Nature Genetics* 8:148-154.

Karlin, S. et al. (1993). "Applications and Statistics for Multiple High-Scoring Segments in Molecular Sequences," *Proc. Natl Acad. Sci. USA* 90:5873-5787.

Keown, W. A. et al. (1990). "Methods for Introducing DNA into Mammalian Cells," *In Methods in Enzymology*, Goeddel, D. V., ed. Academic Press, Inc.,vol. 185, pp. 527-537.

Kettleborough, C.A. et al. (1991). "Humanization of a Mouse Monoclonal Antibody by CDR-Grafting: the Importance of Framework Residues on Loop Conformation," *Protein Engineering* 4(7):773-783.

Kimura, O. et al. (1994). "Retroviral Delivery of DNA into the Livers of Transgenic Mice Bearing Premalignant and Malignant Hepatocellular Carcinomas," *Human Gene Therapy* 5:845-852.

Köhler, G. and Milstein, C. (1975). "Continuous Cultures of Fused Cells Secreting Antibody of Predefined Specificity," *Nature* 256:495-497.

Kohno, T. et al. (2000). "Identification of Genes Associated with the Progression of Adult T-Cell Leukemia (ATL),"*Jpn J. Cancer Res.* 91:1103-1110.

Kyte, J. and Doolittle, R. F. (1982). "A Simple Method for Displaying the Hydropathic Character of a Protein," *J. Mol. Biol.* 157:105-132.

Lee, F. S. et al. (1995). "Insertional Mutagenesis Identifies a Member of the *Wnt* Gene Family as a Candidate Oncogene in the Mammary Epithelium of *int-21/Fgf-3* Transgenic Mice," *Proc. Natl. Acad. Sci. USA* 92:2268-2272.

Lee, S. Wong et al. (1999). "Cloning of Mouse Sepiapterin Reductase Gene and Characterization of its Promoter Region," *Biochimica and Biophysica Acta* 1445(1):165-171.

Letsinger, R. L. et al. (1986). "Effects of Pendant Groups at Phosphorus on Binding Properties of d-ApA Analogues," *Nucl. Acids. Res* 14(8):3487-3499.

Letsinger, R. L. et al. (1988). "Cationic Oligonucleotides," *J. Am. Chem. Soc.* 110:4470-4471.

Letsinger, R.L. and Mungall, W. S. (1970). "Phosphoramidate Analogs of Oligonucleotides," *J. Org. Chem* 35(11):3800-3803.

Li, J. et al. (1999). "Leukaemia Disease Genes: Large-Scale Cloning and Pathway Predictions,"*Nature Genetics* 23:348-353.

LoBuglio, A. F. et al. (1989). "Mouse/Human Chimeric Monoclonal Antibody in Man: Kinetics and Immunune Response," *Proc. Nat. Acad. Sci. USA* 86:4220-4224.

Lockhart, D. J. et al. (1996). "Expression Monitoring by Hybridization To High-Density Oligonucleotide Arrays," *Nature Biotechnology* 14:1675-1680.

Lohuizen, V. (Date unknown). "Web Table A," describing genomic positions insertion site sequences analyzed against the Celera Mouse Genome Database (CMGD Release 12), published in the advance online issue of *Nature Genetics*, 9 pages total.

Lohuizen, V. (Date unknown). "Web Table B," describing Genomic positions of insertion site sequences analyzed against the Ensemble Mouse Genome Database (Feb. 2002 freeze), published in the advance online issue of *Nature Genetics*, 12 pages total.

Lohuizen, V. (Date unknown). "Web Table C," listing GenBank Accession Numbers, published in the advance online issue of *Nature Genetics*, 11 pages total.

Lonberg, N. and Huszar, D. (1995). "Human Antibodies from Transgenic Mice," *Intern. Rev. Immunol.* 13:65-93.

Longberg, N. et al. (1994). "Antigen-Specific Human Antibodies from Mice Comprising Four Distinct Genetic Modifications," *Nature* 368:856-859.

Lund, A. H. et al. (2002). "Genome-Wide Retroviral Insertional Tagging of Genes Involved in Cancer in Cdkn2a-Deficient Mice," *Nature Genetics Advance Online Publication* pp. 1-6.

Luo, L. et al. (1999). "Gene Expression Profiles of Laser-Captured Adjacent Neuronal Subtypes," *Nature Med.* 5:117-122.

Lutz-Freyermuth, C. et al. (1990). "Quantitative Determination That One of Two Potential RNA-Binding Domains of the A Protein Component of the U1 Small Nuclear Ribonucleoprotein Complex Binds with High Affinity to Stem-Loop II of U1 RNA," *Proc. Natl Acad. Sci. USA* 87:6393-6397.

MacArthur, C. A. et al. (1995). "*Fgf-8*, Activated by Proviral Insertion, Cooperates with the *Wnt-1* Transgene in Murine Mammary Tumorigenesis," *J. Virol.* 69(4):2501-2507.

Maddry, J. A. et al. (1994). "Synthesis of Nonionic Oligonucleotide Analogues," Chapter 3 *In Carbohydrate Modifications in Antisense Research*, ACS Symposium Series 580, Shanghvi, Y. S and Cook, P. D, eds, American Chemical Society, Washington, pp. 40-51.

Mag, M. et al. (1991). "Synthesis and Selective Cleavage of an Oligodeoynucleotide Containing a Bridged Internucleotide 5'-Phosphorotiate Linkage," *Nucleic Acids Res.* 19(7):1437-1441.

Marchetti, A. et al. (1995). "*Int-6*, a Highly Conserved, Widely Expressed Gene, is Mutated by Mouse Mammary Tumor Virus in Mammary Preneoplasia," *J. Virol.* 69(3):1932-1938.

Marks, A. et al. (1995). "A Novel Anti-Seminoma Monoclonal Antibody (M2A) Labelled with Technetium-99m: Potential Application for Radioimmunoscintagraphy," *Brit. J. Urol.* 75:225-229.

Marks, J. D. et al. (1991). "By-Passing Immunization, Human Antibodies from V-Gene Libraries Displayed on Phage," *J. Mol. Biol.* 222:581-597.

Marks, J. D. et al. (1992). "By-Passing Immunization: Building High Affinity Human Antibodies by Chain Shuffling," *Bio/Technology* 10:779-783.

Marshall, C. J. (1991). "Tumor Suppressor Genes," *Cell* 64:313-326.

Martin, G. A. et al. (1992). "GAP Domains Responsible for Ras p21-Dependent Inhibition of Muscarinic Atrial K+ Channel Currents," *Science* 255:192-194.

Maskos, U. and Southern, E. M. (1992). "Oligonucleotide Hybridisations on Glass Supports: A Novel Linker for Oligonucleotide Synthesis and Hybridisation Properties of Oligonucleotides" *Synthesised in Situ Nuc. Acids Res.* 20(7):1679-1684.

Masui, A. et al. (1994). "Stabilization and Rational Design of Serine Protease AprM under Highly Alkaline and High_Temperature Conditions," *Appl. Env. Microbiol.* 60(10):3579-3584.

Mather, S. J and Ellison, D. (1990). "Reduction-Mediated Technetium-99m Labeling of Monoclonal Antibodies," *J. Nucl Med.* 31(5):692-697.

Meier, C. and Engels, J.W. (1992). "Peptide Nucleic Acids (PNAs)—Unusual Properties of Nonionic Oligonucleotide Analogues," *Angew Chem. Int. Ed. Engl.* 31(8):1008-1010.

Merrifeld, R. B. (1963). "Solid Phase Peptide Synthesis I. The Synthesis of a Tetrapeptide," *J. Am Chem. Soc.* 85:2149-2154.

Mikkers ,H. et al. (2002). "High-Throughput Retroviral Tagging to Identify Components of Specific Signaling Pathways in Cancer," *Nature Genetics Advance Online Publication*, pp. 1-7.

Miura, Y. et al. (1994). "A *Limulus* Intracellar Coagulation Inhibitor with Characteristics of the Serpin Superfamily," *J. Biol. Chem.* 269:542-547.

Moore, A. S. (2001). "The Role of Chemoattraction in Cancer Metastases," *BioEssays* 23(8):674-676.

Morris, D. W. et al. (1986). "Transfer, by Selective Breeding, of the Pathogenic *Mtv-2* Endogenous Provirus from the GR strain to a Wild Mouse Line Free of Endogenous and Exogenous Mouse Mammary Tumor Virus," *J. Virol.* 58(2):247-252.

Morris, D. W. et al. (1990). "Insertion Mutation of the *Int-1* and *Int-2* Loci by Mouse Mammary Tumor Virus in Premalignant and Malignant Neoplasms from the GR Mouse Strain," *J. Virol.* 64(4):1794-1802.

Morrison, S. L. (1994). "Success in Specification," *Nature* 368:812-813.

Morrison, S. L. and Oi, V. T. (1988). "Genetically Engineered Antibody Molecules," *In Advances In Immunology*, Academic Press, Inc., vol. 44, pp. 65-92.

Morrison, S. L. et al. (1984). "Chimeric Human Antibody Molecules: Mouse Antigen-Binding Domains with Human Constant Region Domains," *Proc. Natl. Acad. Sci USA.* 81:6851-6855.

Müller, A. et al. (2001). "Involvement of Chemokine Receptors in Breast Cancer Metastasis," *Nature* 410:50-56.

Mullis, K. B. et al. (1987). "Specific Synthesis of DNA in Vitro via a Polymerase-Catalyzed Chain Reaction," *In Methods in Enzymology*, Wu, R., ed, Academic Press, Inc. vol. 155, pp. 335-351.

Needleman, S. B. and Wunsch, C. D. (1970). "A General Method Applicable to the Search for Similiarities in the Amino Acid Sequence of Two Proteins," *J. Mol. Biol.* 48:443-453.

Neuberger, M. (1996). "Generating High-Avidity Human Mabs in Mice," *Nature Biotechnology* 14:826 (1 page total).

Neville, D. M. and Youle, R. J. (1982). "Monoclonal Antibody-Ricin or Ricin A Chain Hybrids: Kinetic Analysis of Cell Killing for Tumor Therapy," *Immunol Rev* 62:75-91.

Nielsen (1991). "Sequence-Selective Recognition of DNA by Strand Displacement with a Thymine-Substituted Polyamide," *Science* 254:1497-1500.

Nielsen, P. E. (1999)."Applications of Peptide Nucleic Acids," *Curr. Opin. Biotechnol.* 10:71-75.

Nusse, R. and Varmus, H. E. (1982). "Many Tumors Induced by the Mouse Mammary Tumor Virus Contain a Provirus Integrated in the Same Region of the Host Genome," *Cell* 31:99-109.

Nygren, H. (1982). "Conjugation of Horseradish Peroxidase to Fab Fragments with Different Homobifunctional and Heterobifunctional Cross-Linking Reagents," *The J. Histochem. and Cytochem.* 30(5):407-412.

Paborsky, L. R. et al. (1990). "Mammalian Cell Transient Expression of Tissue Factor for the Production of Antigen," *Protein Engineering* 3(6):547-553.

Padlan, E. A. (1991). "A Possible Procedure for Reducing the Immunogenecity of Antibody Variable Domains While Preserving their Ligand-Binding Properties," *Molec. Immunol.* 28(4/5):489-498.

Padlan, E. A. (1994). "Anatomy of the Antibody Molecule," *Molecular Immunology* 31(3):169-217.

Pain, D. and Surolia, A. (1981). "Preparation of Protein A-Peroxidase Monoconjugate Using A.Heterobifunctional Reagent, and its Use in Enzyme Immunoassays," *J. Immunol. Meth.* 40:219-230.

Palmarini, M. et al. (1999). "Jaagsiekte Sheep Retrovirus is Necessary and Sufficient to Induce a Contagious Lung Cancer in Sheep," *J. Virol.* 73(8):6964-6972.

Patanjali, S. R. et al. (1991). "Construction of a Uniform-Abundance (Normalized) cDNA Library,"*Proc. Natl. Acad. Sci USA* 88(5):1943-1947.

Pauwels, R. et al. (1986). "Biological Activity of New 2-5A Analogues," *Chemica Scripta* 26:141-145.

Pearson, W. R. and Lipman, D. J. (1988). "Improved Tools for Biological Sequence Comparison," *Proc. Natl Acad. Sci. USA* 85:2444-2448.

Pease, A. C. et al. (1994). "Light-Generated Oligonucleotide Arrays for Rapid DNA Sequence Analysis," *Proc. Natl. Acad. Sci. USA* 91(11):5022-5026.

Peters, G. et al. (1983). "Tumorigenesis by Mouse Mammary Turmor Virus: Evidence for a Common Region for Provirus Integration in Mammary Tumors," *Cell* 33:369-377.

Peters, G. et al. (1989). "The Mouse Homolog of the *Hst/k-FGF* Gene is Adjacent to *int-2* and is Activated by Proviral Insertion in Some Virally Induced Mammary Tumors," *Proc. Natl. Acad. Sci. USA* 86:5678-5682.

Pevzner, P. A. (1989). "1-Tuple DNA Sequencing: Computer Analysis," *J. Biomol. Struct & Dyn.* 7(1):63-73.

Pevzner, P. A. et al. (1991). "Improved Chips for Sequencing by Hybridization," *J. Biomol. Struc. & Dyn* 9:399-410.

Philip, R. et al. (1994). "Efficient and Sustained Gene Expression in Primary T Lymphocytes and Primary and Cultured Tumor Cells Mediated by Adeno-Associated Virus Plasmid DNA Complexed to Cationic Liposomes," *Mol. Cell Biol.* 14(14):2411-2418.

Pierce (1994). "Cross-Linking," *Pierce Catalog and Handbook* pp. 155-200.

Presta, L. G. (1992). "Antibody Engineering", *Current Opinion in Structural Biology* 2:593-596.

Querol, E. et al. (1996). "Analysis of Protein Conformational Characteristics Related to Thermostability," *Prot. Eng.* 9:265-271.

Raso, V. et al. (1982). "Monoclonal Antibody-Ricin A Chain Conjugate Selectively Cytotoxic for Cells Bearing the Common Acute Lymphoblastic Leukemia Antigen," *Cancer Res* 42:457-464.

Rawls, R. L. (1997). "Optimistic About Antisense," *C & E. News* pp. 35-40.

Riechmann, L. et al. (1988). "Reshaping Human Antibodies for Therapy," *Nature* 332:323-327.

Roelink, H. et al. (1990). "*Wnt-3*, a Gene Activated by Proviral Insertion in Mouse Mammary Tumors is Homologous to *int-1/Wnt-1* and is Normally Expressed in Mouse Embryos and Adult Brain," *Proc. Natl. Acad. Sci USA* 87:4519-4523.

Ross, W. C. J. et al. (1980). "Increased Toxicity of Diphteria Toxin for Human Lymphoblastoid Cells Following Covalent Linkage to Anti-(Human Lymphocyte) Globulin or Its F(ab')$_2$ Fragment," *Eur J. Biochem* 104:381-390.

Saiki, R. K. et al. (1988). "Primer-Directed Enzymatic Amplification of DNA with Thermostable DNA Polymerase," *Science* 239:487-491.

Sambrook, J. et al. (1989). "In Vitro Amplication of DNA by Polymerase Chain Reaction," Chapter 14 *In Molecular Cloning: A Laboratory Manual.* CSH Press 1989. pp. 14.2-14.33.

Sambrook, J. et al. (1989). "Expression of Cloned Genes in Cultured Mammalian Cells," Chapter 16 *In Molecular Cloning: A Laboratory Manual*. Cold Spring Harbor laboratory Press pp. 16.17-16.40.

Sambrook, J. et al., eds. (1989). *Molecular Cloning, a Laboratory Manual*, Second Edition. Cold Spring Harbor Laboraroty Press. pp. xi-xxxviii. (Table of Contents Only).

Sano, T. and Cantor, C. R. (1991). "A Streptavidin-Protein A Chimera that Allows One-Step Production of a Variety of Specific Antibody Conjugates," *Bio/Technology* 9:1378-1381.

Sawai, H. et al. (1984). "Synthesis and Properties of Oligoadenylic Acids Containing 2'-5' Phosphoramide Linkage," *Chem. Lett.* pp. 805-808.

Schena, M. et al. (1995). "Quantitative Monitoring of Gene Expression Patterns with a Complementary DNA Microarray," *Science* 270:467-470.

Schoots, O. et al. (1999). "Co-Expression of Human Kir3 Subunits Can Yield Channels with Different Functional Properties," *Cell Signal.* 11(12):871-883.

Scopes, R. K.,ed. (1982). *Protein Purification: Principles and Practice*. Springer-Verlag:New York, Heidelberg, Berlin, pp. xi-xiii.

Shaw, D. R. et al. (1987). "Characterization of a Mouse/Human Chimeric Monoclonal Antibody (17-1A) to a Colon Cancer Tumor-Associated Antigen," *J. Immunol.* 138(12):4534-4538.

Shiramizu, B. et al. (1994). "Identification of a Common Clonal Human Immunodeficiency Virus Integration Site in Human Immunodeficiency Virus-Associated Lymphomas," *Cancer Res.* 54:2069-2072.

Skea, D. L. and Barber, B. H. (1993). "Studies of the Adjuvant-Independent Antibody Response to Immunotargeting," *J. Immunol.* 151(7):3557-3568.

Skinner, R. H. et al. (1991). "Use of the Glu-Glu-Phe C-Terminal Epitope for Rapid Purification of the Catalytic Domain of Normal and Mutant *Ras* GTPase-Activating Proteins," *J. Biol. Chem.* 266(22):14163-14166.

Smith, S. B. et al. (1992). "Direct Mechanical Measurements of the Elasticity of Single DNA Molecules by Using Magnetic Beads," *Science* 258:1122-1126.

Smith, T. F. and Waterman, M. S. (1981). "Comparison of Biosequences," *Adv. Appl. Math.* 2:482-489.

Sojar, H. T. and Bahl, O. P. (1987). "A Chemical Method for the Deglycosylation of Proteins," *Archives of Biochemistry and Biophysics* 259(1):52-57.

Sorensen, A. B. et al. (1993). "Amplification and Sequence Analysis of DNA Flanking Integrated Proviruses by a Simple Two-Step Polymerase Chain Reaction Method," *Journal of Virology* 67(12):7118-7124.

Sorensen, A. B. et al. (1996). "Sequence Tags of Provirus Integration Sites in DNAs of Tumors Induced by the Murine Retrovirus SL3-3," *Journal of Virology* 70(6):4063-4070.

Sorensen, A. B. et al. (2000). "Sintl, a Common Integration Site in SL3-3-Induced T-Cell Lymphomas, Harbors a Putative Proto-Oncogene with Homology to the Septin Gene Family, "*J. Virology* 74(5):2161-2168.

Southern, E. M. (1975). "Detection of Specific Sequences Among DNA Fragments Separated by Gel Electrophoresis," *J. Mol. Biol.* 98:503-517.

Sprinzl, M. et al. (1977). "Enzymatic Incorporation of ATP and CTP Analogues Into the 3' End of tRNA," *Eur. J. Biochem* 81:579-589.

Stein, C. A. and Cohen, J. S. (1988). "Oligodeoxynucleotides as Inhibitors of Gene Expression: A Review," *Cancer Res.* 48:2659-2668.

Sternsdorf, T. et al. (1997). "Nuclear Dots: Actors on Many Stages," *Immunobiology* 198:307-331.

Suzuki, T. et al. (2002). "New Genes Involved in Cancer Identified by Retroviral Tagging," *Nature Genetics Advance Online Publication* pp. 1-9.

Suzuki, T. et al. (2002). "Web Note A, CIS Definition, Retroviral Tagging in the Post-Genome Era Identifies New Genes Involved in Cancer". (1 page total).

Thotakura, N. R. and Bahl, O. P. (1987). "Enzymathic Deglycosylation of Glycoproteins," *In Methods in Enzymology*, Complex Carbohydrates, Part EAcademic Press, Inc., vol. 138 pp. 350-359.

Tijssen (1993). "Overview of Principles of Hybridization and the strategy of nucleic acid assays," Chapter 2 *In Laboratory Techniques in Biochemistry and Molecular Biology*, Hybridization with Nucleic Acid Probes Van der Vliet, P. C., ed. Elsevier, Amsterdam, London, New York, and Tokyo, vol. 24 pp. 20-78.

Toma, S. et al. (1991). "Grafting of A Calcium-Binding Loop of Thermolysin to *Bacillus subtilis* Neutral Protease," *Biochemistry* 30:97-106.

Trowbridge, I. S. and Domingo, D. L. (1981). "Anti-Transferrin Receptor Monoclonal Antibody and Toxin-Antibody Conjurates Affects Growth of Human Tumour Cells," *Nature* 294:171-173.

Urdea, M. S. et al. (1991). "Branched DNA Amplification Multimers for the Sensitive, Direct, Detection of Human Hepatitis Viruses," Symposium Series No. 24, *Nucleic Acids Symp. Ser* 24:197-200.

Van der Krol, A. R et al. (1988). "Modulation of Eukaryotic Gene Expression by Complementary RNA or DNA Sequences," *BioTechniques* 6(10):958-976.

Varmus, H. E. (1983). "Using Retroviruses as Insertional Mutagens to Identify Cellular Oncogenes," *In Oncogenes and Retroviruses: Evaluation of Basic Findings and Clinical Potential*. Alan R. Liss, Inc., New York. pp. 23-35.

Vaughn, J. et al. (2000). "Genomic Structure and Expression of Human *KCNJ9* (Kir3.3/GIRK3)," *Biochem. Biophys. Res. Commun* 274(2):302-309.

Verhoeyen, M. et al. (1988). "Reshaping Human Antibodies: Grafting an Antilysozyme Activity," *Science* 239:1534-1536.

Vitteta, E. S. et al. (1982). "Neoplastic B Cells as Targets for Antibody-Ricin A Chain Immunotoxin," *Immunol. Rev* 62:158-183.

von Kiedrowski, G. et al. (1991). "Parabolic Growth of a Self-Replicating Hexadeoxynucleotide Bearing a 3'-5'-Phosphoamidate Linkage," *Angew. Chem. Int. Ed. Engl* 30(4):423-426.

Wakarchuk, W. W. et al. (1994). "Thermostabilization of the Bacillus Circulans Xylanase by the Introduction of Disulfide Bonds," *Protein Eng.* 7(11):1379-1386.

Waldmann, T. A. (1991). "Monoclonal Antibodies in Diagnosis and Therapy," *Science* 252:1657-1662.

Washington University. (2002). "Washington University BLAST Archives" located at <http://blast.wustl.edu> visited on Dec. 15, 2002, three pages.

Weinberg, R. A . (1991). "Tumor Suppresso Genes," *Science* 254:1138-1146.

Weiner, L. M. et al. (2001). "Therapeutic Monoclonal Antibodies: General Principles," Section 5 of Chapter 20 *In Cancer: Principles and Practice of Oncology*, DeVita, V. T. et al. , eds. 6$^{th}$ Edition, Lippincott Williams & Wilkins, pp. 495-508.

Weissman, S. M. (1987). "Molecular Genetic Techniques for Mapping the Human Genome," *Mol. Biol. Med* 4:133-143.

Welling, G. W. et al. (1985). "Prediction of Sequential Antigenic Regions in Proteins," *Antigenicity Index FEBS Lett.* 188(2):215-218.

Winter, G. and Milstein, C. (1991). "Man-Made Antibodies," *Nature* 349:293-299.

Woffendin, C. et al. (1994). "Nonviral and Viral Delivery of a Human Immunodeficiency Virus Protective Gene Into Human T. Cells," *Proc. Natl. Acad. Sci USA* 91:11581-11585.

Wolford, J. K. (2001). "Analysis of Linkage Disequilibrium Between Polymorphisms in the *KCNJ9* Gene with Type 2 Diabetes Mellitus in Pima Indians," *Mol. Genet. Metab* 73(1):97-103.

Wright, D. K. and Manos, M. M. (1990). "Sample Preparation from Paraffin-Embedded Tissues," Chapter 19 *In PCR Protocols: A Guide to Methods and Applications*, Innis, M. A. et al., eds Academic Press, pp. 153-158.

Wu, G. Y. and Wu, C. H. (1988). "Receptor-Mediated Gene Delivery and Expression in Vivo," *J. Biol. Chem.* 263(29):14621-14624.

Wu, H. W. et al. (1989). "Targeting Genes: Delivery and Persistent Expression of a Foreign Gene Driven by Mammalian Regulatory Elements in Vivo," *Biol. Chem* 264(29):16985-16987.

Zenke, M. et al. (1990). "Receptor-Mediated Endocytosis of Transferrin-Polycation Conjugates: An Efficient Way to Introduce DNA Into Hematopoietic Cells," *Proc. Natl. Acad. Sci USA* 87:3655-3659.

Zhang, W-X and Yang, S. Y. (2000). "Cloning and Characterization of a New Member of the T-Box Gene Family," *Genomics* 70(1):41-48.

Zhang, Z. M. et al. (1992). "Evaluation of Reduction-meditated labeling of Antibodies with Technetium-99m," *Nucl. Med. Biol.* 19(6):607-609.

Zlokarnik, G. et al. (1998). "Quantitation of Transcription and Clonal Selection of Single Living Cells with β-Lactamase as Reporter," *Science* 279:84-88.

Dong, Y., et al, "Molecular Cloning and Characterization of LR3, a Novel LDL Receptor Family Protein with Mitogenic Activity", Biochemical and Biophysical Research Communications, vol. 251, No. 3, Oct. 29, 1998, pp. 784-790.

Schneider, W. J., et al, "LDL receptor relatives at the crossroad of endocytosis and signaling", CMLS Cellular and Molecular Life Sciences, vol. 60, No. 5, May 2003, pp. 892-903.

Allen, L. F. et al. (Dec. 1991). "G-Protein-Coupled Receptor Genes as Protooncogenes: Constitutively Activating Mutation of the $\alpha_{1B}$-Adrenergic Receptor Enhances Mitogenesis and Tumorigenicity," *Proceedings of the National Academy of Sciences of the United States of America* 88(24):11324-11358.

Arihiro, K. et al. (Jan. 2000). "Significance of $\alpha 9\beta 1$ and $\alpha v\beta 6$ Integrin Expression in Breast Carcinoma," *Breast Cancer* 7(1):19-26.

Augenlicht, L. H. et al. (Mar. 1982). "Cloning and Screening of Sequences Expressed in a Mouse Colon Tumor," *Cancer Research* 42:1088-1093.

Berns, A.(1988). "Provirus Tagging as an Instrument to Identify Oncogenes and to Establish Synergism Between Oncogenes," *Archives of Virology* 102:1-18.

Database GenCore, Accession No. U78076, created on May 14, 1999, last visited on Oct. 24, 2004. Lee et al. "Cloning of Mouse Sepiapterin Reductase Gene and Characterization of its Promoter Region," Gene Sequence, *Biochim. Biophys. Acta* (1999). vol. 1445 No. 1 pp. 165-171. MPSRCH Search Report, 2004, 1 page.

Duh, F-M. et al. (Aug. 1994). "cDNA Cloning and Expression of the Human Homolog of the Sea Urchin *fascin* and *Drosophila Singed* Genes Which Encodes an Actin-Bundling Protein," *DNA and Cell Biology* 13(8):821-827.

Hibi, K. et al. (1994). "Aberrant Upregulation of a Novel Integrin $\alpha$ Subunit Gene at 3p21.3 in Small Cell Lung Cancer," *Oncogene* 9:611-619.

Höpken, U. E. et al. (Feb. 15, 2002). "Up-Regulation of the Chemokine Receptor CCR7 in Classical but Not in Lymphocyte-Predominant Hodgkin Disease Correlates with Distinct Dissemination of Neoplastic Cells in Lymphoid Organs," *Blood* 99(4):1109-116.

Invitation to Pay Additional Fees mailed on Dec. 10, 2004 for PCT patent application No. PCT/US2004/004730 filed on Feb. 17, 2004, 11 pages.

Khan, J. et al. (1999). "Expression Profiling in Cancer Using cDNA Microarrays," *Electrophoresis* 20:223-229.

Mosialos, G. et al. (Nov. 1994). "Epstein-Barr Virus Infection Expression in B Lymphocytes of a Novel Gene Encoding an Evolutionarily Conserved 55-Kilodalton Actin-Bundling Protein," *Journal of Virology* 68(11):7320-7328.

Palmer, E. L. et al. (Dec. 1993). "Sequence and Tissue Distribution of the Integrin $\alpha 9$ Subunit, a Novel Partner of $\beta 1$ That is Widely Distributed in Epithelia and Muscle," *The Journal of Cell Biology* 123(5):1289-1297.

Zhang, L. et al. (May 23, 1997). "Gene Expression Profiles in Normal and Cancer Cells," *Science* 276:1268-1272.

\* cited by examiner

Figure 2.

Average Ct

| Sample | Housekeeper | Target |
|---|---|---|
| Human Genomic_clontech | 23.40229767 | 24.718297 |
| Malignant mammary adenocarcinoma pleural effusion | 24.57459367 | 25.62105175 |
| Mammary ductal carcinoma plueral effusion | 23.935565 | 25.064095 |
| Mammary ductal carcinoma_human _45537 | 24.06496275 | 24.8361145 |
| Mammary ductal carcinoma_human_45523 | 24.286542 | 25.59857167 |
| Mammary ductal carcinoma_human_45535 | 24.271219 | 25.62112767 |
| transformed primary embryonal kidney_human | 24.136573 | 25.86051867 |

Figure 3.

Target Normalized with Housekeeper

Sample

| Sample | ΔCt | Stdev (ΔCt) |
|---|---|---|
| Human Genomic_clontech (Calibrator) | 1.69 | 0.22 |
| Malignant mammary adenocarcinoma pleural effusion | -1.85 | 0.14 |
| Mammary ductal carcinoma plueral effusion | 1.12 | 0.24 |
| Mammary ductal carcinoma_human _45537 | 1.02 | 0.16 |
| Mammary ductal carcinoma_human_45523 | 0.49 | 0.26 |
| Mammary ductal carcinoma_human_45535 | 1.03 | 0.18 |
| transformed primary embryonal kidney_human | 1.81 | 0.15 |

Figure 4.

Target Normalized with Housekeeper

| Sample | ΔCt | Stdev (ΔCt) | ΔΔCt | Stdev (ΔΔCt) | Comparative expression level |
|---|---|---|---|---|---|
| Human Genomic_clontech (Calibrator) | 1.69 | 0.22 | 0 | 0.22 | 1 |
| Malignant mammary adenocarcinoma pleural effusion | -1.85 | 0.14 | -3.54 | 0.14 | 11.60 |
| Mammary ductal carcinoma plueral effusion | 1.12 | 0.24 | -0.57 | 0.24 | 1.48 |
| Mammary ductal carcinoma_human_45537 | 1.02 | 0.16 | -0.67 | 0.16 | 1.59 |
| Mammary ductal carcinoma_human_45523 | 0.49 | 0.26 | -1.20 | 0.26 | 2.30 |
| Mammary ductal carcinoma_human_45535 | 1.03 | 0.18 | -0.66 | 0.18 | 1.58 |
| transformed primary embryonal kidney_human | 1.81 | 0.15 | 0.12 | 0.15 | 0.92 |

THERAPEUTIC TARGETS IN CANCER

CROSS-REFERENCE TO RELATED APPLICATIONS

This application is a divisional of U.S. Ser. No. 10/367,094, filed Feb. 14, 2003 now abandoned. This application is related to U.S. Applications entitled "Novel Compositions and Methods in Cancer," U.S. Ser. No. 10/034,650, filed Dec. 20, 2001; U.S. Ser. No. 10/035,832, filed Dec. 26, 2001; U.S. Ser. No. 10/004,113, filed Oct. 23, 2001; U.S. Ser. No. 09/997,722, filed Nov. 30, 2001; U.S. Ser. No. 10/085,117, filed Feb. 27, 2002; U.S. Ser. No. 10/387,192, filed Mar. 1, 2002; U.S. Ser. No. 10/322,281, filed Dec. 17, 2002; U.S. Ser. No. 10/322,696, filed Dec. 17, 2002, U.S. Ser. No. 10/331,053, filed Dec. 26, 2002; and U.S. Ser. No. 10/330,773, filed Dec. 27, 2002. All of the preceding applications are expressly incorporated herein by reference in their entirety.

DESCRIPTION OF ACCOMPANYING CD-ROMS

Tables 1-27 are filed herewith in CD-ROM in accordance with 37 C.F.R. §§1.52 and 1.58. Two identical copies (marked "Copy 1" and "Copy 2") of this CD-ROM are submitted.

Contents of the CD-ROM disks submitted herewith are hereby incorporated by reference into the Specification.

TECHNICAL FIELD OF THE INVENTION

This invention relates generally to the field of cancer-associated genes. Specifically, it relates to novel sequences for use in diagnosis and treatment of cancer and tumors, as well as the use of the novel compositions in screening methods. The present invention provides methods of using cancer associated polynucleotides, their corresponding gene products and antibodies specific for the gene products in the detection, diagnosis, prevention and/or treatment of associated cancers.

BACKGROUND OF THE INVENTION

Oncogenes are genes that can cause cancer. Carcinogenesis can occur by a wide variety of mechanisms, including infection of cells by viruses containing oncogenes, activation of protooncogenes in the host genome, and mutations of protooncogenes and tumor suppressor genes. Carcinogenesis is fundamentally driven by somatic cell evolution (i.e. mutation and natural selection of variants with progressive loss of growth control). The genes that serve as targets for these somatic mutations are classified as either protooncogenes or tumor suppressor genes, depending on whether their mutant phenotypes are dominant or recessive, respectively.

There are a number of viruses known to be involved in human cancer as well as in animal cancer. Of particular interest here are viruses that do not contain oncogenes themselves; these are slow-transforming retroviruses. They induce tumors by integrating into the host genome and affecting neighboring protooncogenes in a variety of ways. Provirus insertion mutation is a normal consequence of the retroviral life cycle. In infected cells, a DNA copy of the retrovirus genome (called a provirus) is integrated into the host genome. A newly integrated provirus can affect gene expression in cis at or near the integration site by one of two mechanisms. Type I insertion mutations up-regulate transcription of proximal genes as a consequence of regulatory sequences (enhancers and/or promoters) within the proviral long terminal repeats (LTRs). Type II insertion mutations cause truncation of coding regions due to either integration directly within an open reading frame or integration within an intron flanked on both sides by coding sequences. The analysis of sequences at or near the insertion sites has led to the identification of a number of new protooncogenes.

With respect to lymphoma and leukemia, retroviruses such as AKV murine leukemia virus (MLV) or SL3-3 MLV, are potent inducers of tumors when inoculated into susceptible newborn mice, or when carried in the germline. A number of sequences have been identified as relevant in the induction of lymphoma and leukemia by analyzing the insertion sites; see Sorensen et al., J. of Virology 74:2161 (2000); Hansen et al., Genome Res. 10(2):237-43 (2000); Sorensen et al., J. Virology 70:4063 (1996); Sorensen et al., J. Virology 67:7118 (1993); Joosten et al., Virology 268:308 (2000); and Li et al., Nature Genetics 23:348 (1999); all of which are expressly incorporated by reference herein. With respect to cancers, especially breast cancer, prostate cancer and cancers with epithelial origin, the mammalian retrovirus, mouse mammary tumor virus (MMTV) is a potent inducer of tumors when inoculated into susceptible newborn mice, or when carried in the germ line. *Mammary Tumors in the Mouse*, edited by J. Hilgers and M. Sluyser; Elsevier/North-Holland Biomedical Press; New York, N.Y.

The pattern of gene expression in a particular living cell is characteristic of its current state. Nearly all differences in the state or type of a cell are reflected in the differences in RNA levels of one or more genes. Comparing expression patterns of uncharacterized genes may provide clues to their function. High throughput analysis of expression of hundreds or thousands of genes can help in (a) identification of complex genetic diseases, (b) analysis of differential gene expression over time, between tissues and disease states, and (c) drug discovery and toxicology studies. Increase or decrease in the levels of expression of certain genes correlate with cancer biology. For example, oncogenes are positive regulators of tumorigenesis, while tumor suppressor genes are negative regulators of tumorigenesis. (Marshall, Cell, 64: 313-326 (1991); Weinberg, Science, 254: 1138-1146 (1991)).

Accordingly, it is an object of the invention to provide polynucleotide and polypeptide sequences involved in cancer and, in particular, in oncogenesis.

Immunotherapy, or the use of antibodies for therapeutic purposes has been used in recent years to treat cancer. Passive immunotherapy involves the use of monoclonal antibodies in cancer treatments. See for example, *Cancer: Principles and Practice of Oncology*, 6$^{th}$ Edition (2001) Chapt. 20 pp. 495-508. Inherent therapeutic biological activity of these antibodies include direct inhibition of tumor cell growth or survival, and the ability to recruit the natural cell killing activity of the body's immune system. These agents are administered alone or in conjunction with radiation or chemotherapeutic agents. Rituxan® and Herceptin®, approved for treatment of lymphoma and breast cancer, respectively, are two examples of such therapeutics. Alternatively, antibodies are used to make antibody conjugates where the antibody is linked to a toxic agent and directs that agent to the tumor by specifically binding to the tumor. Mylotarg® is an example of an approved antibody conjugate used for the treatment of leukemia.

Accordingly, it is another object of this invention to provide antigens (cancer-associated polypeptides) associated with a variety of cancers as targets for diagnostic and/or therapeutic antibodies. These antigens are also useful for drug

SUMMARY OF THE INVENTION

In accordance with the objects outlined above, the present invention provides methods for screening for compositions that modulate cancer, especially lymphoma and leukemia. The present invention also provides methods for screening for compositions which modulate carcinomas, especially mammary adenocarcinomas. Also provided herein are methods of inhibiting proliferation of a cell, preferably a lymphoma cell or a breast cancer cell. Methods of treatment of cancer, including diagnosis, are also provided herein.

In one aspect, a method of screening drug candidates comprises providing a cell that expresses a cancer-associated (CA) gene or fragments thereof. Preferred embodiments of CA genes are genes that are differentially expressed in cancer cells, preferably lymphatic, breast, prostate or epithelial cells, compared to other cells. Preferred embodiments of CA genes used in the methods herein include, but are not limited to the nucleic acids selected from Tables 1-27 (human genomic sequences of SEQ ID NOS: 4, 10, 16, 26, 32, 38, 50, 56, 66, 74, 77, 83, 93, 99, 105, 111, 117, 125, 133, 139, 145, 151, 163, 169, 179, 189, 195, and 201, and sequences of SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 corresponding to the human mRNAs generated therefrom). The methods further include adding a drug candidate to the cell and determining the effect of the drug candidate on the expression of the CA gene.

In one embodiment, the method of screening drug candidates includes comparing the level of expression in the absence of the drug candidate to the level of expression in the presence of the drug candidate.

Also provided herein is a method of screening for a bioactive agent capable of binding to a CA protein (CAP), the method comprising combining the CAP and a candidate bioactive agent, and determining the binding of the candidate agent to the CAP.

Further provided herein is a method for screening for a bioactive agent capable of modulating the activity of a CAP. In one embodiment, the method comprises combining the CAP and a candidate bioactive agent, and determining the effect of the candidate agent on the bioactivity of the CAP.

Also provided is a method of evaluating the effect of a candidate cancer drug comprising administering the drug to a patient and removing a cell sample from the patient. The expression profile of the cell is then determined. This method may further comprise comparing the expression profile of the patient to an expression profile of a healthy individual.

In a further aspect, a method for inhibiting the activity of a CA protein is provided. In one embodiment, the method comprises administering to a patient an inhibitor of a CA protein preferably selected from the group consisting of the sequences outlined in Tables 1-27 (SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203).

A method of neutralizing the effect of a CA protein, preferably a protein encoded by a nucleic acid selected from the group of sequences outlined in Tables 1-27 (human genomic sequences of SEQ ID NOS: 4, 10, 16, 26, 32, 38, 50, 56, 66, 74, 77, 83, 93, 99, 105, 111, 117, 125, 133, 139, 145, 151, 163, 169, 179, 189, 195, and 201, and sequences of SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 corresponding to the human mRNAs generated therefrom), is also provided. Preferably, the method comprises contacting an agent specific for said protein with said protein in an amount sufficient to effect neutralization.

Moreover, provided herein is a biochip comprising a nucleic acid segment which encodes a CA protein, preferably selected from the sequences outlined in Tables 1-27 (SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202).

Also provided herein is a method for diagnosing or determining the propensity to cancers, especially lymphoma or leukemia or carcinoma by sequencing at least one carcinoma or lymphoma gene of an individual. In yet another aspect of the invention, a method is provided for determining cancer including lymphoma and leukemia gene copy numbers in an individual.

The invention provides an isolated nucleic acid comprising at least 10, 12, 15, 20 or 30 contiguous nucleotides of a sequence selected from the group consisting of the polynucleotide sequences SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 shown in Tables 1-27, or its complement, or an expression vector comprising the isolated nucleic acids and host cells comprising them.

In some embodiments, the polynucleotide, or its complement or a fragment thereof, further comprises a detectable label, is attached to a solid support, is prepared at least in part by chemical synthesis, is an antisense fragment, is single stranded, is double stranded or comprises a microarray.

The invention provides an isolated polypeptide, encoded within an open reading frame of a CA sequence selected from the group consisting of the polynucleotide sequences of SEQ ID NOS: 4, 10, 16, 26, 32, 38, 50, 56, 66, 74, 77, 83, 93, 99, 105, 111, 117, 125, 133, 139, 145, 151, 163, 169, 179, 189, 195, and 201 shown in Tables 1-27, or its complement. The invention provides an isolated polypeptide, wherein said polypeptide comprises the amino acid sequence encoded by a polynucleotide selected from the group consisting of SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 shown in Tables 1-27. The invention provides an isolated polypeptide, wherein said polypeptide comprises the amino acid sequence encoded by a polypeptide selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27.

The invention further provides an isolated polypeptide, comprising the amino acid sequence of an epitope of the amino acid sequence of a CA polypeptide selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27, wherein the polypeptide or fragment thereof may be attached to a solid support. In one embodiment the invention provides an isolated antibody (monoclonal or polyclonal) or antigen binding fragment thereof, that binds to such a polypeptide. The isolated antibody or antigen binding fragment thereof may be attached to a solid support, or further comprises a detectable label.

In one embodiment, the invention provides a kit for diagnosing the presence of cancer in a test sample, said kit comprising at least one polynucleotide that selectively hybridizes to a CA polynucleotide sequence shown in Tables 1-27, or its complement. In another embodiment. the invention provides an electronic library comprising a CA polynucleotide, a CA polypeptide, or fragment thereof, shown in Tables 1-27.

In one embodiment, the invention provides a method of screening for anticancer activity comprising: (a) providing a cell that expresses a cancer associated (CA) gene encoded by a nucleic acid sequence selected from the group consisting of the CA sequences shown in Tables 1-27, or fragment thereof; (b) contacting a tissue sample derived from a cancer cell with an anticancer drug candidate; (c) monitoring an effect of the anticancer drug candidate on an expression of the CA polynucleotide in the tissue sample, and optionally (d) comparing the level of expression in the absence of said drug candidate to the level of expression in the presence of the drug candidate. The drug candidate may be an inhibitor of transcription, a G-protein coupled receptor antagonist, a growth factor antagonist, a serine-threonine kinase antagonist, a tyrosine kinase antagonist.

In one embodiment, the invention provides a method for detecting cancer associated with expression of a polypeptide in a test cell sample, comprising the steps of: (i) detecting a level of expression of at least one polypeptide selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27, or a fragment thereof; and (ii) comparing the level of expression of the polypeptide in the test sample with a level of expression of polypeptide in a normal cell sample, wherein an altered level of expression of the polypeptide in the test cell sample relative to the level of polypeptide expression in the normal cell sample is indicative of the presence of cancer in the test cell sample.

In another embodiment, the invention provides a method for detecting cancer associated with expression of a polypeptide in a test cell sample, comprising the steps of: (i) detecting a level of activity of at least one polypeptide selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27, or a fragment thereof, wherein said activity corresponds to at least one activity for the polypeptide listed in Table 29; and (ii) comparing the level of activity of the polypeptide in the test sample with a level of activity of polypeptide in a normal cell sample, wherein an altered level of activity of the polypeptide in the test cell sample relative to the level of polypeptide activity in the normal cell sample is indicative of the presence of cancer in the test cell sample.

In another embodiment, the invention provides a method for detecting cancer associated with the presence of an antibody in a test serum sample, comprising the steps of: (i) detecting a level of an antibody against an antigenic polypeptide selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27, or antigenic fragment thereof; and (ii) comparing said level of said antibody in the test sample with a level of said antibody in the control sample, wherein an altered level of antibody in said test sample relative to the level of antibody in the control sample is indicative of the presence of cancer in the test serum sample.

The invention provides a method for screening for a bioactive agent capable of modulating the activity of a CA protein (CAP), wherein said CAP is encoded by a nucleic acid comprising a nucleic acid sequence selected from the group consisting of the polynucleotide sequences SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 shown in Tables 1-27, said method comprising: a) combining said CAP and a candidate bioactive agent; and b) determining the effect of the candidate agent on the bioactivity of said CAP. According to the method the bioactive agent: affects the expression of the CA protein (CAP); affects the activity of the CA protein (CAP), wherein such activity is selected from the activities listed in Table 29; is a modulator of ion transport and further wherein the nucleic acid sequence is selected from the group consisting of SEQ ID NOS: 41, 83, 113, 181, 183 and 119 shown in Tables 1-27; is a modulator of amino acid transport and further wherein the nucleic acid sequence is selected from the group consisting of SEQ ID NOS: 41, 53, 59, 175, 177, and 119; is a stimulator of apoptosis and further wherein the nucleic acid sequence is selected from the group consisting of SEQ ID NOS: 149, 155 and 161; is an inhibitor of cell adhesion and further wherein the nucleic acid sequence is selected from the group consisting of SEQ ID NOS: 17, 77, 95, 179, 101, and 125; is a modulator of signalling and further wherein the nucleic acid sequence is selected from the group consisting of SEQ ID NOS: 35, 47, 107, 143, 149, 167 and 185; and/or is a tyrosine kinase antagonist and further wherein the nucleic acid sequence is selected from the group consisting of SEQ ID NOS: 89, and 137.

In one embodiment, the invention provides a method for diagnosing cancer comprising: a) determining the expression of one or more genes comprising a nucleic acid sequence selected from the group consisting of the human genomic and mRNA sequences outlined in Tables 1-27, in a first tissue type of a first individual; and b) comparing said expression of said gene(s) from a second normal tissue type from said first individual or a second unaffected individual; wherein a difference in said expression indicates that the first individual has cancer.

In another embodiment the invention provides a method for treating cancers comprising administering to a patient a bioactive agent modulating the activity of a CA protein (CAP), wherein said CAP is encoded by a nucleic acid comprising a nucleic acid sequence selected from the group consisting of the human nucleic acid sequences in Tables 1-27 and further wherein the bioactive agent: binds to the CA protein; is a modulator of ion transport and further wherein the CAP sequence is selected from the group consisting of SEQ ID NOS: 42, 84, 114, 182, 184 and 120; is a G-protein coupled receptor antagonist and further wherein the CAP sequence is SEQ ID NO: 12; is a modulator of amino acid transport and further wherein the CAP sequence is selected from the group consisting of SEQ ID NOS: 42, 54, 60, 176, 178, and 120; is a stimulator of apoptosis and further wherein the CAP sequence is selected from the group consisting of SEQ ID NOS: 150, 156 and 162; and/or is an inhibitor of cell adhesion and further wherein the CAP sequence is selected from the group consisting of SEQ ID NOS: 18, 78, 96, 180, 102, and 126, as shown in Tables 1-27.

The invention provides monoclonal antibodies that preferentially binds to a CA protein (CAP) that is expressed on a cell surface, wherein the CA protein selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203; preferably to the extracellular domain of the CA protein; preferably to a CA protein differentially expressed on a cancer cell surface relative to a normal cell surface or preferably to at least one human cancer cell line; preferably linked to a therapeutic agent; or preferably humanized. Kits and pharmaceutical compositions for detecting a presence or an absence of cancer cells in an individual, and comprising such antibodies are also provided.

The invention also provides a method for detecting a presence or an absence of cancer cells in an individual, the method comprising: contacting cells from the individual with the antibody according to the invention; and detecting a complex of a CAP from the cancer cells and the antibody, wherein detection of the complex correlates with the presence of cancer cells in the individual. In one embodiment the invention provides a method for inhibiting growth of cancer cells in an individual, the method comprising: administering to the individual an effective amount of a pharmaceutical composition according to the invention. In another embodiment the invention provides a method for delivering a therapeutic agent to cancer cells in an individual, the method comprising: administering to the individual an effective amount of a pharmaceutical composition according to according to the invention.

Novel sequences associated with cancer are also provided herein. Other aspects of the invention will become apparent to the skilled artisan by the following description of the invention.

BRIEF DESCRIPTION OF THE FIGURES

FIG. 2 shows an example of average threshold cycle ($C_T$) values for a housekeeper gene and target gene.

FIG. 3 shows an example of the calculated difference ($\Delta\Delta C_T$) between the $C_T$ values of target and housekeeper genes ($\Delta C_T$) for various samples.

FIG. 4 shows the $\Delta\Delta C_T$ and comparative expression level for each sample from FIG. 3.

DETAILED DESCRIPTION OF PREFERRED EMBODIMENTS

Figure 1:
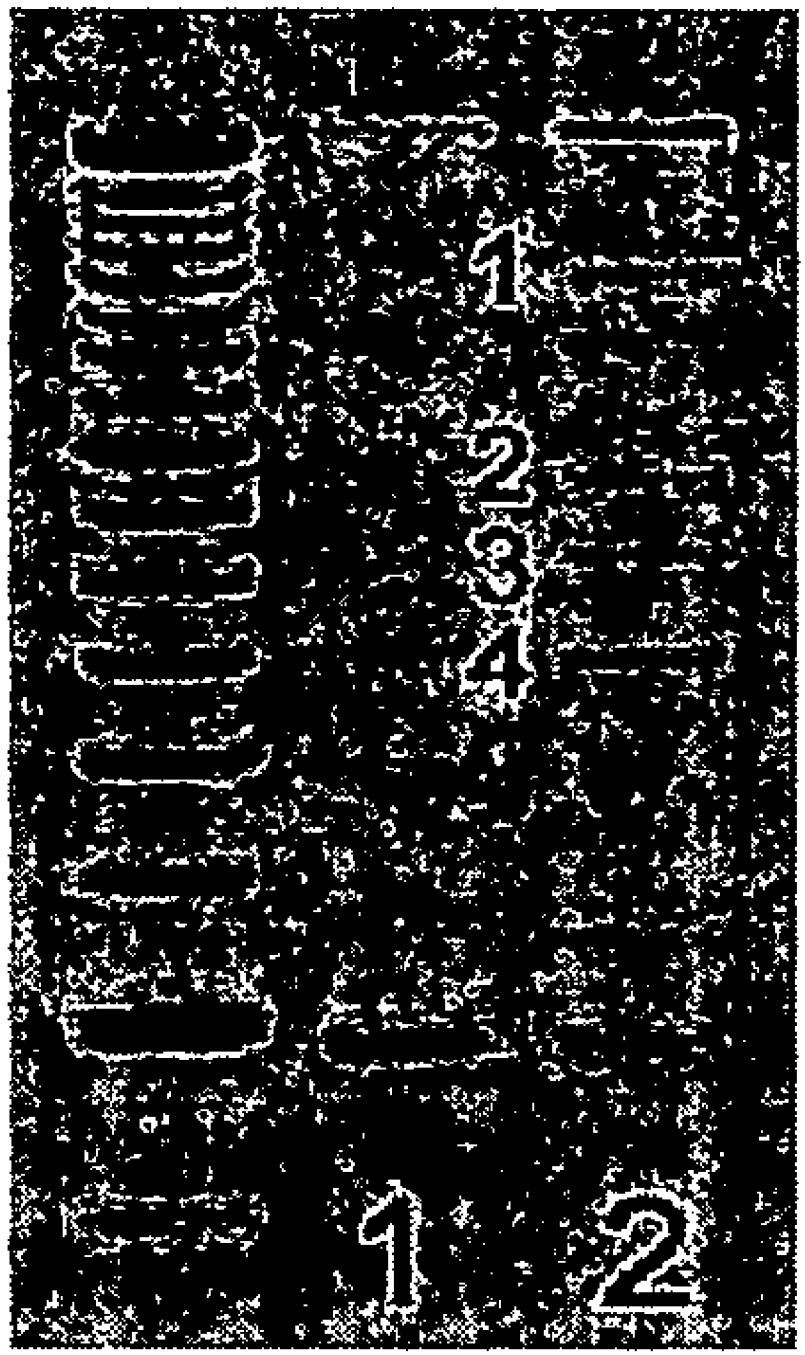
FIG. 1 depicts PCR amplification of host-provirus junction fragments.

The present invention is directed to a number of sequences associated with cancers, especially lymphoma, breast cancer or prostate cancer. The relatively tight linkage between clonally-integrated proviruses and protooncogenes forms "provirus tagging", in which slow-transforming retroviruses that act by an insertion mutation mechanism are used to isolate protooncogenes. In some models, uninfected animals have low cancer rates, and infected animals have high cancer rates. It is known that many of the retroviruses involved do not carry transduced host protooncogenes or pathogenic trans-acting viral genes, and thus the cancer incidence must therefore be a direct consequence of proviral integration effects into host protooncogenes. Since proviral integration is random, rare integrants will "activate" host protooncogenes that provide a selective growth advantage, and these rare events result in new proviruses at clonal stoichiometries in tumors. In contrast to mutations caused by chemicals, radiation, or spontaneous errors, protooncogene insertion mutations can be easily located by virtue of the fact that a convenient-sized genetic marker of known sequence (the provirus) is present at the site of mutation. Host sequences that flank clonally integrated proviruses can be cloned using a variety of strategies. Once these sequences are in hand, the tagged protooncogenes can be subsequently identified. The presence of provirus at the same locus in two or more independent tumors is prima facie evidence that a protooncogene is present at or very near the provirus integration sites. This is because the genome is too large for random integrations to result in observable clustering. Any clustering that is detected is unequivocal evidence for biological selection (i.e. the tumor phenotype). Moreover, the pattern of proviral integrants (including orientations) provides compelling positional information that makes localization of the target gene at each cluster relatively simple. The three mammalian retroviruses that are known to cause cancer by an insertion mutation mechanism are FeLV (leukemia/lymphoma in cats), MLV (leukemia/lymphoma in mice and rats), and MMTV (mammary cancer in mice).

Thus, the use of oncogenic retroviruses, whose sequences insert into the genome of the host organism resulting in cancer, allows the identification of host sequences involved in cancer. These sequences may then be used in a number of different ways, including diagnosis, prognosis, screening for modulators (including both agonists and antagonists), antibody generation (for immunotherapy and imaging), etc. However, as will be appreciated by those in the art, oncogenes that are identified in one type of cancer such as lymphoma or leukemia have a strong likelihood of being involved in other types of cancers as well. Thus, while the sequences outlined herein are initially identified as correlated with lymphoma, they can also be found in other types of cancers as well, outlined below.

DEFINITIONS

Accordingly, the present invention provides nucleic acid and protein sequences that are associated with cancer, herein termed "cancer associated" or "CA" sequences. In one embodiment, the present invention provides nucleic acid and protein sequences that are associated with cancers that originate in lymphatic tissue, herein termed "lymphoma associated," "leukemia associated" or "LA" sequences. In another embodiment, the present invention provides nucleic acid and protein sequences that are associated with carcinomas which originate in breast tissue, herein termed "breast cancer associated" or "BC" sequences.

Suitable cancers that can be diagnosed or screened for using the methods of the present invention include cancers classified by site or by histological type. Cancers classified by site include cancer of the oral cavity and pharynx (lip, tongue, salivary gland, floor of mouth, gum and other mouth, nasopharynx, tonsil, oropharynx, hypopharynx, other oral/pharynx); cancers of the digestive system (esophagus; stomach; small intestine; colon and rectum; anus, anal canal, and anorectum; liver; intrahepatic bile duct; gallbladder; other biliary; pancreas; retroperitoneum; peritoneum, omentum, and mesentery; other digestive); cancers of the respiratory system (nasal cavity, middle ear, and sinuses; larynx; lung and bronchus; pleura; trachea, mediastinum, and other respiratory); cancers of the mesothelioma; bones and joints; and soft tissue, including heart; skin cancers, including melanomas and other non-epithelial skin cancers; Kaposi's sarcoma and breast cancer; cancer of the female genital system (cervix uteri; corpus uteri; uterus, nos; ovary; vagina; vulva; and other female genital); cancers of the male genital system (prostate gland; testis; penis; and other male genital); cancers of the urinary system (urinary bladder; kidney and renal pelvis; ureter; and other urinary); cancers of the eye and orbit; cancers of the brain and nervous system (brain; and other nervous system); cancers of the endocrine system (thyroid gland and other endocrine, including thymus); lymphomas (Hodgkin's disease and non-Hodgkin's lymphoma), multiple myeloma, and leukemias (lymphocytic leukemia; myeloid leukemia; monocytic leukemia; and other leukemias).

Other cancers, classified by histological type, that may be associated with the sequences of the invention include, but are not limited to, Neoplasm, malignant; Carcinoma, NOS; Carcinoma, undifferentiated, NOS; Giant and spindle cell carcinoma; Small cell carcinoma, NOS; Papillary carcinoma, NOS; Squamous cell carcinoma, NOS; Lymphoepithelial carcinoma; Basal cell carcinoma, NOS; Pilomatrix carcinoma; Transitional cell carcinoma, NOS; Papillary transitional cell carcinoma; Adenocarcinoma, NOS; Gastrinoma, malignant; Cholangiocarcinoma; Hepatocellular carcinoma, NOS; Combined hepatocellular carcinoma and cholangiocarcinoma; Trabecular adenocarcinoma; Adenoid cystic carcinoma; Adenocarcinoma in adenomatous polyp; Adenocarcinoma, familial polyposis coli; Solid carcinoma, NOS; Carcinoid tumor, malignant; Bronchiolo-alveolar adenocarcinoma; Papillary adenocarcinoma, NOS; Chromophobe carcinoma; Acidophil carcinoma; Oxyphilic adenocarcinoma; Basophil carcinoma; Clear cell adenocarcinoma, NOS; Granular cell carcinoma; Follicular adenocarcinoma, NOS; Papillary and follicular adenocarcinoma; Nonencapsulating sclerosing carcinoma; Adrenal cortical carcinoma; Endometroid carcinoma; Skin appendage carcinoma; Apocrine adenocarcinoma; Sebaceous adenocarcinoma; Ceruminous adenocarcinoma; Mucoepidermoid carcinoma; Cystadenocarcinoma, NOS; Papillary cystadenocarcinoma, NOS; Papillary serous cystadenocarcinoma; Mucinous cystadenocarcinoma, NOS; Mucinous adenocarcinoma; Signet ring cell carcinoma; Infiltrating duct carcinoma; Medullary carcinoma, NOS; Lobular carcinoma; Inflammatory carcinoma; Paget's disease, mammary; Acinar cell carcinoma; Adenosquamous carcinoma; Adenocarcinoma w/squamous metaplasia; Thymoma, malignant; Ovarian stromal tumor, malignant; Thecoma, malignant; Granulosa cell tumor, malignant; Androblastoma, malignant; Sertoli cell carcinoma; Leydig cell tumor, malignant; Lipid cell tumor, malignant; Paraganglioma, malignant; Extra-mammary paraganglioma, malignant; Pheochromocytoma; Glomangiosarcoma; Malignant melanoma, NOS; Amelanotic melanoma; Superficial spreading melanoma; Malig melanoma in giant pigmented nevus; Epithelioid cell melanoma; Blue nevus, malignant; Sarcoma, NOS; Fibrosarcoma, NOS; Fibrous histiocytoma, malignant; Myxosarcoma; Liposarcoma, NOS; Leiomyosarcoma, NOS; Rhabdomyosarcoma, NOS; Embryonal rhabdomyosarcoma; Alveolar rhabdomyosarcoma; Stromal sarcoma, NOS; Mixed tumor, malignant, NOS; Mullerian mixed tumor; Nephroblastoma; Hepatoblastoma; Carcinosarcoma, NOS; Mesenchymoma, malignant; Brenner tumor, malignant; Phyllodes tumor, malignant; Synovial sarcoma, NOS; Mesothelioma, malignant; Dysgerminoma; Embryonal carcinoma, NOS; Teratoma, malignant, NOS; Struma ovarii, malignant; Choriocarcinoma; Mesonephroma, malignant; Hemangiosarcoma; Hemangioendothelioma, malignant; Kaposi's sarcoma; Hemangiopericytoma, malignant; Lymphangiosarcoma; Osteosarcoma, NOS; Juxtacortical osteosarcoma; Chondrosarcoma, NOS; Chondroblastoma, malignant; Mesenchymal chondrosarcoma; Giant cell tumor of bone; Ewing's sarcoma; Odontogenic tumor, malignant; Ameloblastic odontosarcoma; Ameloblastoma, malignant; Ameloblastic fibrosarcoma; Pinealoma, malignant; Chordoma; Glioma, malignant; Ependymoma, NOS; Astrocytoma, NOS; Protoplasmic astrocytoma; Fibrillary astrocytoma; Astroblastoma; Glioblastoma, NOS; Oligodendroglioma, NOS; Oligodendroblastoma; Primitive neuroectodermal; Cerebellar sarcoma, NOS; Ganglioneuroblastoma; Neuroblastoma, NOS; Retinoblastoma, NOS; Olfactory neurogenic tumor; Meningioma, malignant; Neurofibrosarcoma; Neurilemmoma, malignant; Granular cell tumor, malignant; Malignant lymphoma, NOS; Hodgkin's disease, NOS; Hodgkin's; paragranuloma, NOS; Malignant lymphoma, small lymphocytic; Malignant lymphoma, large cell, diffuse; Malignant lymphoma, follicular, NOS; Mycosis fungoides; Other specified non-Hodgkin's lymphomas; Malignant histiocytosis; Multiple myeloma; Mast cell sarcoma; Immunoproliferative small intestinal disease; Leukemia, NOS; Lymphoid leukemia, NOS; Plasma cell leukemia; Erythroleukemia; Lymphosarcoma cell leukemia; Myeloid leukemia, NOS; Basophilic leukemia; Eosinophilic leukemia; Monocytic leukemia, NOS; Mast cell leukemia; Megakaryoblastic leukemia; Myeloid sarcoma; and Hairy cell leukemia.

In addition, the CA genes may be involved in other diseases such as, but not limited to, diseases associated with aging or neurodegeneration.

"Association" in this context means that the nucleotide or protein sequences are either differentially expressed, activated, inactivated or altered in cancers as compared to normal tissue. As outlined below, CA sequences include those that are up-regulated (i.e. expressed at a higher level), as well as those that are down-regulated (i.e. expressed at a lower level), in cancers. CA sequences also include sequences that have been altered (i.e., truncated sequences or sequences with substitutions, deletions or insertions, including point mutations) and show either the same expression profile or an altered profile. In a preferred embodiment, the CA sequences are from humans; however, as will be appreciated by those in the art, CA sequences from other organisms may be useful in animal models of disease and drug evaluation; thus, other CA sequences are provided, from vertebrates, including mammals, including rodents (rats, mice, hamsters, guinea pigs, etc.), primates, and farm animals (including sheep, goats, pigs, cows, horses, etc). In some cases, prokaryotic CA sequences may be useful. CA sequences from other organisms may be obtained using the techniques outlined below.

CA sequences include both nucleic acid and amino acid sequences. In a preferred embodiment, the CA sequences are recombinant nucleic acids. By the term "recombinant nucleic acid" herein is meant nucleic acid, originally formed in vitro, in general, by the manipulation of nucleic acid by polymerases and endonucleases, in a form not normally found in nature. Thus a recombinant nucleic acid is also an isolated nucleic acid, in a linear form, or cloned in a vector formed in vitro by ligating DNA molecules that are not normally joined, are both considered recombinant for the purposes of this invention. It is understood that once a recombinant nucleic acid is made and reintroduced into a host cell or organism, it will replicate using the in vivo cellular machinery of the host cell rather than in vitro manipulations; however, such nucleic acids, once produced recombinantly, although subsequently replicated in vivo, are still considered recombinant or isolated for the purposes of the invention. As used herein a "polynucleotide" or "nucleic acid" is a polymeric form of nucleotides of any length, either ribonucleotides or deoxyribonucleotides. This term refers only to the primary structure of the molecule. Thus, this term includes double- and single-stranded DNA and RNA. It also includes known types of modifications, for example, labels which are known in the art, methylation, "caps", substitution of one or more of the naturally occurring nucleotides with an analog, internucleotide modifications such as, for example, those with uncharged linkages (e.g., phosphorothioates, phosphorodithioates, etc.), those containing pendant moieties, such as, for example proteins (including e.g., nucleases, toxins, antibodies, signal peptides, poly-L-lysine, etc.), those with intercalators (e.g., acridine, psoralen, etc.), those containing chelators (e.g., metals, radioactive metals, etc.), those containing alkylators, those with modified linkages (e.g., alpha anomeric nucleic acids, etc.), as well as unmodified forms of the polynucleotide.

As used herein, a polynucleotide "derived from" a designated sequence refers to a polynucleotide sequence which is comprised of a sequence of approximately at least about 6 nucleotides, preferably at least about 8 nucleotides, more preferably at least about 10-12 nucleotides, and even more preferably at least about 15-20 nucleotides corresponding to a region of the designated nucleotide sequence. "Corresponding" means homologous to or complementary to the designated sequence. Preferably, the sequence of the region from which the polynucleotide is derived is homologous to or complementary to a sequence that is unique to a CA gene.

Similarly, a "recombinant protein" is a protein made using recombinant techniques, i.e. through the expression of a recombinant nucleic acid as depicted above. A recombinant protein is distinguished from naturally occurring protein by at least one or more characteristics. For example, the protein may be isolated or purified away from some or all of the proteins and compounds with which it is normally associated in its wild type host, and thus may be substantially pure. For example, an isolated protein is unaccompanied by at least some of the material with which it is normally associated in its natural state, preferably constituting at least about 0.5%, more preferably at least about 5% by weight of the total protein in a given sample. A substantially pure protein comprises about 50-75% by weight of the total protein, with about 80% being preferred, and about 90% being particularly preferred. The definition includes the production of a CA protein from one organism in a different organism or host cell. Alternatively, the protein may be made at a significantly higher concentration than is normally seen, through the use of an inducible promoter or high expression promoter, such that the protein is made at increased concentration levels. Alternatively, the protein may be in a form not normally found in nature, as in the addition of an epitope tag or amino acid substitutions, insertions and deletions, as discussed below.

In a preferred embodiment, the CA sequences are nucleic acids. As will be appreciated by those in the art and is more fully outlined below, CA sequences are useful in a variety of applications, including diagnostic applications, which will detect naturally occurring nucleic acids, as well as screening applications; for example, biochips comprising nucleic acid probes to the CA sequences can be generated. In the broadest sense, use of "nucleic acid," "polynucleotide" or "oligonucleotide" or equivalents herein means at least two nucleotides covalently linked together. In some embodiments, an oligonucleotide is an oligomer of 6, 8, 10, 12, 20, 30 or up to 100 nucleotides. A "polynucleotide" or "oligonucleotide" may comprise DNA, RNA, PNA or a polymer of nucleotides linked by phosphodiester and/or any alternate bonds.

A nucleic acid of the present invention generally contains phosphodiester bonds, although in some cases, as outlined below (for example, in antisense applications or when a nucleic acid is a candidate drug agent), nucleic acid analogs may have alternate backbones, comprising, for example, phosphoramidate (Beaucage et al., Tetrahedron 49(10):1925 (1993) and references therein; Letsinger, J. Org. Chem. 35:3800 (1970); Sprinzl et al., Eur. J. Biochem. 81:579 (1977); Letsinger et al., Nucl. Acids Res. 14:3487 (1986); Sawai et al, Chem. Lett. 805 (1984), Letsinger et al., J. Am. Chem. Soc. 110:4470 (1988); and Pauwels et al., Chemica Scripta 26:141 91986)), phosphorothioate (Mag et al., Nucleic Acids Res. 19:1437 (1991); and U.S. Pat. No. 5,644, 048), phosphorodithioate (Briu et al., J. Am. Chem. Soc. 111:2321 (1989), O-methylphosphoroamidite linkages (see Eckstein, Oligonucleotides and Analogues: A Practical Approach, Oxford University Press), and peptide nucleic acid backbones and linkages (see Egholm, J. Am. Chem. Soc. 114:1895 (1992); Meier et al., Chem. Int. Ed. Engl. 31:1008 (1992); Nielsen, Nature, 365:566 (1993); Carlsson et al., Nature 380:207 (1996), all of which are incorporated by reference). Other analog nucleic acids include those with positive backbones (Denpcy et al., Proc. Natl. Acad. Sci. USA 92:6097 (1995); non-ionic backbones (U.S. Pat. Nos. 5,386, 023, 5,637,684, 5,602,240, 5,216,141 and 4,469,863; Kiedrowshi et al., Angew. Chem. Intl. Ed. English 30:423 (1991); Letsinger et al., J. Am. Chem. Soc. 110:4470 (1988); Letsinger et al., Nucleoside & Nucleotide 13:1597 (1994); Chapters 2 and 3, ASC Symposium Series 580, "Carbohydrate Modifications in Antisense Research", Ed.Y. S. Sanghui and P. Dan Cook; Mesmaeker et al., Bioorganic & Medicinal Chem. Lett. 4:395 (1994); Jeffs et al., J. Biomolecular NMR 34:17 (1994); Tetrahedron Lett. 37:743 (1996)) and non-ribose backbones, including those described in U.S. Pat. Nos. 5,235,033 and 5,034,506, and Chapters 6 and 7, ASC Symposium Series 580, "Carbohydrate Modifications in Antisense Research", Ed. Y. S. Sanghui and P. Dan Cook. Nucleic acids containing one or more carbocyclic sugars are also included within one definition of nucleic acids (see Jenkins et al., Chem. Soc. Rev. (1995) pp 169-176). Several nucleic acid analogs are described in Rawls, C & E News Jun. 2, 1997 page 35. All of these references are hereby expressly incorporated by reference. These modifications of the ribose-phosphate backbone may be done for a variety of reasons, for example to increase the stability and half-life of such molecules in physiological environments for use in anti-sense applications or as probes on a biochip.

As will be appreciated by those in the art, all of these nucleic acid analogs may find use in the present invention. In addition, mixtures of naturally occurring nucleic acids and analogs can be made; alternatively, mixtures of different nucleic acid analogs, and mixtures of naturally occurring nucleic acids and analogs may be made.

The nucleic acids may be single stranded or double stranded, as specified, or contain portions of both double stranded or single stranded sequence. As will be appreciated by those in the art, the depiction of a single strand "Watson" also defines the sequence of the other strand "Crick"; thus the sequences described herein also includes the complement of the sequence. The nucleic acid may be DNA, both genomic and cDNA, RNA, or a hybrid, where the nucleic acid contains any combination of deoxyribo- and ribo-nucleotides, and any combination of bases, including uracil, adenine, thymine, cytosine, guanine, inosine, xanthine, hypoxanthine, isocytosine, isoguanine, etc. As used herein, the term "nucleoside" includes nucleotides and nucleoside and nucleotide analogs, and modified nucleosides such as amino modified nucleosides. In addition, "nucleoside" includes non-naturally occurring analog structures. Thus for example the individual units of a peptide nucleic acid, each containing a base, are referred to herein as a nucleoside.

As used herein, the term "tag," "sequence tag" or "primer tag sequence" refers to an oligonucleotide with specific nucleic acid sequence that serves to identify a batch of polynucleotides bearing such tags therein. Polynucleotides from the same biological source are covalently tagged with a specific sequence tag so that in subsequent analysis the polynucleotide can be identified according to its source of origin. The sequence tags also serve as primers for nucleic acid amplification reactions.

A "microarray" is a linear or two-dimensional array of preferably discrete regions, each having a defined area, formed on the surface of a solid support. The density of the discrete regions on a microarray is determined by the total numbers of target polynucleotides to be detected on the surface of a single solid phase support, preferably at least about $50/cm^2$, more preferably at least about $100/cm^2$, even more preferably at least about $500/cm^2$, and still more preferably at least about $1,000/cm^2$. As used herein, a DNA microarray is an array of oligonucleotide primers placed on a chip or other surfaces used to amplify or clone target polynucleotides. Since the position of each particular group of primers in the array is known, the identities of the target polynucleotides can be determined based on their binding to a particular position in the microarray.

A "linker" is a synthetic oligodeoxyribonucleotide that contains a restriction site. A linker may be blunt end-ligated onto the ends of DNA fragments to create restriction sites that can be used in the subsequent cloning of the fragment into a vector molecule.

The term "label" refers to a composition capable of producing a detectable signal indicative of the presence of the target polynucleotide in an assay sample. Suitable labels include radioisotopes, nucleotide chromophores, enzymes, substrates, fluorescent molecules, chemiluminescent moieties, magnetic particles, bioluminescent moieties, and the like. As such, a label is any composition detectable by spectroscopic, photochemical, biochemical, immunochemical, electrical, optical, chemical, or any other appropriate means. The term "label" is used to refer to any chemical group or moiety having a detectable physical property or any compound capable of causing a chemical group or moiety to exhibit a detectable physical property, such as an enzyme that catalyzes conversion of a substrate into a detectable product. The term "label" also encompasses compounds that inhibit the expression of a particular physical property. The label may also be a compound that is a member of a binding pair, the other member of which bears a detectable physical property.

The term "support" refers to conventional supports such as beads, particles, dipsticks, fibers, filters, membranes, and silane or silicate supports such as glass slides.

The term "amplify" is used in the broad sense to mean creating an amplification product which may include, for example, additional target molecules, or target-like molecules or molecules complementary to the target molecule, which molecules are created by virtue of the presence of the target molecule in the sample. In the situation where the target is a nucleic acid, an amplification product can be made enzymatically with DNA or RNA polymerases or reverse transcriptases.

As used herein, a "biological sample" refers to a sample of tissue or fluid isolated from an individual, including but not limited to, for example, blood, plasma, serum, spinal fluid, lymph fluid, skin, respiratory, intestinal and genitourinary tracts, tears, saliva, milk, cells (including but not limited to blood cells), tumors, organs, and also samples of in vitro cell culture constituents.

The term "biological sources" as used herein refers to the sources from which the target polynucleotides are derived. The source can be of any form of "sample" as described above, including but not limited to, cell, tissue or fluid. "Different biological sources" can refer to different cells/tissues/organs of the same individual, or cells/tissues/organs from different individuals of the same species, or cells/tissues/organs from different species.

Cancer-Associated Sequences

The CA sequences of the invention were initially identified by infection of mice with a retrovirus such as murine leukemia virus (MLV) resulting in lymphoma. Retroviruses have a genome that is made out of RNA. After a retrovirus infects a host cell, a double stranded DNA copy of the retrovirus genome (a "provirus") is inserted into the genomic DNA of the host cell. The integrated provirus may affect the expression of host genes at or near the site of integration—a phenomenon known as retroviral insertional mutagenesis. Possible changes in the expression of host cell genes include: (i) increased expression of genes near the site of integration resulting from the proximity of elements in the provirus that act as transcriptional promoters and enhancers, (ii) functional inactivation of a gene caused by the integration of a provirus into the gene itself thus preventing the synthesis of a functional gene product, or (iii) expression of a mutated protein that has a different activity to the normal protein. Typically such a protein would be prematurely truncated and lack a regulatory domain near the C terminus. Such a protein might be constitutively active, or act as a dominant negative inhibitor of the normal protein. For example, retrovirus enhancers, including that of SL3-3, are known to act on genes up to approximately 200 kilobases from the insertion site. Moreover, many of these sequences are also involved in other cancers and disease states. Sequences of mouse genes according to this invention, that are identified in this manner are shown as mDxx-yyy in Tables 1-27.

A CA sequence can be initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

In one embodiment, CA sequences are those that are up-regulated in cancers; that is, the expression of these genes is higher in cancer tissue as compared to normal tissue of the same differentiation stage. "Up-regulation" as used herein means increased expression by about 50%, preferably about 100%, more preferably about 150% to about 200%, with up-regulation from 300% to 1000% being preferred.

In another embodiment, CA sequences are those that are down-regulated in cancers; that is, the expression of these genes is lower in cancer tissue as compared to normal tissue of the same differentiation stage. "Down-regulation" as used herein means decreased expression by about 50%, preferably about 100%, more preferably about 150% to about 200%, with down-regulation from 300% to 1000% to no expression being preferred.

In yet another embodiment, CA sequences are those that have altered sequences but show either the same or an altered expression profile as compared to normal lymphoid tissue of the same differentiation stage. "Altered CA sequences" as used herein also refers to sequences that are truncated, contain insertions or contain point mutations.

CA proteins of the present invention may be classified as secreted proteins, transmembrane proteins or intracellular proteins. In a preferred embodiment the CA protein is an intracellular protein. Intracellular proteins may be found in the cytoplasm and/or in the nucleus. Intracellular proteins are involved in all aspects of cellular function and replication (including, for example, signaling pathways); aberrant expression of such proteins results in unregulated or disregulated cellular processes. For example, many intracellular proteins have enzymatic activity such as protein kinase activity, protein phosphatase activity, protease activity, nucleotide cyclase activity, polymerase activity and the like. Intracellular proteins also serve as docking proteins that are involved in organizing complexes of proteins, or targeting proteins to various subcellular localizations, and are involved in maintaining the structural integrity of organelles.

An increasingly appreciated concept in characterizing intracellular proteins is the presence in the proteins of one or more motifs for which defined functions have been attributed. In addition to the highly conserved sequences found in the enzymatic domain of proteins, highly conserved sequences have been identified in proteins that are involved in protein-protein interaction. For example, Src-homology-2 (SH2) domains bind tyrosine-phosphorylated targets in a sequence dependent manner. PTB domains, which are distinct from SH2 domains, also bind tyrosine phosphorylated targets. SH3 domains bind to proline-rich targets. In addition, PH domains, tetratricopeptide repeats and WD domains to name only a few, have been shown to mediate protein-protein interactions. Some of these may also be involved in binding to phospholipids or other second messengers. As will be appreciated by one of ordinary skill in the art, these motifs can be identified on the basis of primary sequence; thus, an analysis of the sequence of proteins may provide insight into both the enzymatic potential of the molecule and/or molecules with which the protein may associate.

In a preferred embodiment, the CA sequences are transmembrane proteins. Transmembrane proteins are molecules that span the phospholipid bilayer of a cell. They may have an intracellular domain, an extracellular domain, or both. The intracellular domains of such proteins may have a number of functions including those already described for intracellular proteins. For example, the intracellular domain may have enzymatic activity and/or may serve as a binding site for additional proteins. Frequently the intracellular domain of transmembrane proteins serves both roles. For example certain receptor tyrosine kinases have both protein kinase activity and SH2 domains. In addition, autophosphorylation of tyrosines on the receptor molecule itself creates binding sites for additional SH2 domain containing proteins.

Transmembrane proteins may contain from one to many transmembrane domains. For example, receptor tyrosine kinases, certain cytokine receptors, receptor guanylyl cyclases and receptor serine/threonine protein kinases contain a single transmembrane domain. However, various other proteins including channels and adenylyl cyclases contain numerous transmembrane domains. Many important cell surface receptors are classified as "seven transmembrane domain" proteins, as they contain 7 membrane spanning regions. Important transmembrane protein receptors include, but are not limited to insulin receptor, insulin-like growth factor receptor, human growth hormone receptor, glucose transporters, transferrin receptor, epidermal growth factor receptor, low density lipoprotein receptor, leptin receptor, interleukin receptors, e.g. IL-1 receptor, IL-2 receptor, etc. CA proteins may be derived from genes that regulate apoptosis (IL-3, GM-CSF and Bcl-x) or are shown to have a role in the regulation of apoptosis.

Characteristics of transmembrane domains include approximately 20 consecutive hydrophobic amino acids that may be followed by charged amino acids. Therefore, upon analysis of the amino acid sequence of a particular protein, the localization and number of transmembrane domains within the protein may be predicted.

The extracellular domains of transmembrane proteins are diverse; however, conserved motifs are found repeatedly among various extracellular domains. Conserved structure and/or functions have been ascribed to different extracellular motifs. For example, cytokine receptors are characterized by a cluster of cysteines and a WSXWS (W=tryptophan, S=serine, X=any amino acid) motif. Immunoglobulin-like domains are highly conserved. Mucin-like domains may be involved in cell adhesion and leucine-rich repeats participate in protein-protein interactions.

Many extracellular domains are involved in binding to other molecules. In one aspect, extracellular domains are receptors. Factors that bind the receptor domain include circulating ligands, which may be peptides, proteins, or small molecules such as adenosine and the like. For example, growth factors such as EGF, FGF and PDGF are circulating growth factors that bind to their cognate receptors to initiate a variety of cellular responses. Other factors include cytokines, mitogenic factors, neurotrophic factors and the like. Extracellular domains also bind to cell-associated molecules. In this respect, they mediate cell-cell interactions. Cell-associated ligands can be tethered to the cell for example via a glycosylphosphatidylinositol (GPI) anchor, or may themselves be transmembrane proteins. Extracellular domains also associate with the extracellular matrix and contribute to the maintenance of the cell structure.

CA proteins that are transmembrane are particularly preferred in the present invention as they are good targets for immunotherapeutics, as are described herein. In addition, as outlined below, transmembrane proteins can be also useful in imaging modalities.

It will also be appreciated by those in the art that a transmembrane protein can be made soluble by removing transmembrane sequences, for example through recombinant methods. Furthermore, transmembrane proteins that have been made soluble can be made to be secreted through recombinant means by adding an appropriate signal sequence.

In a preferred embodiment, the CA proteins are secreted proteins; the secretion of which can be either constitutive or regulated. These proteins have a signal peptide or signal sequence that targets the molecule to the secretory pathway. Secreted proteins are involved in numerous physiological events; by virtue of their circulating nature, they serve to transmit signals to various other cell types. The secreted protein may function in an autocrine manner (acting on the cell that secreted the factor), a paracrine manner (acting on cells in close proximity to the cell that secreted the factor) or an endocrine manner (acting on cells at a distance). Thus secreted molecules find use in modulating or altering numerous aspects of physiology. CA proteins that are secreted proteins are particularly preferred in the present invention as they serve as good targets for diagnostic markers, for example for blood tests.

CA Sequences and Homologs

A CA sequence is initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

As used herein, a nucleic acid is a "CA nucleic acid" if the overall homology of the nucleic acid sequence to one of the nucleic acids of Tables 1-27 is preferably greater than about 75%, more preferably greater than about 80%, even more preferably greater than about 85% and most preferably greater than 90%. In some embodiments the homology will be as high as about 93 to 95 or 98%. In a preferred embodiment, the sequences that are used to determine sequence identity or similarity are selected from those of the nucleic acids of Tables 1-27. In another embodiment, the sequences are naturally occurring allelic variants of the sequences of the nucleic acids of Tables 1-27. In another embodiment, the sequences are sequence variants as further described herein.

Homology in this context means sequence similarity or identity, with identity being preferred. A preferred comparison for homology purposes is to compare the sequence containing sequencing errors to the correct sequence. This homology will be determined using standard techniques known in the art, including, but not limited to, the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, PNAS USA 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res. 12:387-395 (1984), preferably using the default settings, or by inspection.

One example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, J. Mol. Evol. 35:351-360 (1987); the method is similar to that described by Higgins & Sharp CABIOS 5:151-153 (1989). Useful PILEUP parameters include a default gap weight of 3.00, a default gap length weight of 0.10, and weighted end gaps.

Another example of a useful algorithm is the BLAST (Basic Local Alignment Search Tool) algorithm, described in Altschul et al., J. Mol. Biol. 215, 403-410, (1990) and Karlin et al., PNAS USA 90:5873-5787 (1993). A particularly useful BLAST program is the WU-BLAST-2 program which was obtained from Altschul et al., Methods in Enzymology, 266: 460-480 (1996); http://blast.wustl.edu/]. WU-BLAST-2 uses several search parameters, most of which are set to the default values. The adjustable parameters are set with the following values: overlap span=1, overlap fraction=0.125, word threshold (T)=11. The HSP S and HSP S2 parameters are dynamic values and are established by the program itself depending upon the composition of the particular sequence and composition of the particular database against which the sequence of interest is being searched; however, the values may be adjusted to increase sensitivity. A percent amino acid sequence identity value is determined by the number of matching identical residues divided by the total number of residues of the "longer" sequence in the aligned region. The "longer" sequence is the one having the most actual residues in the aligned region (gaps introduced by WU-Blast-2 to maximize the alignment score are ignored).

Thus, "percent (%) nucleic acid sequence identity" is defined as the percentage of nucleotide residues in a candidate sequence that are identical with the nucleotide residues of the nucleic acids of Tables 1-27. A preferred method utilizes the BLASTN module of WU-BLAST-2 set to the default parameters, with overlap span and overlap fraction set to 1 and 0.125, respectively.

The alignment may include the introduction of gaps in the sequences to be aligned. In addition, for sequences which contain either more or fewer nucleotides than those of the nucleic acids of Tables 1-27, it is understood that the percentage of homology will be determined based on the number of homologous nucleosides in relation to the total number of nucleosides. Thus homology of sequences shorter than those of the sequences identified herein will be determined using the number of nucleosides in the shorter sequence.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC ("saline sodium citrate"; 9 mM NaCl, 0.9 mM sodium citrate), 0.5% SDS, 1.0 mM EDTA (pH 8.0); hybridizing at 50-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60-65° C., or 65-70° C. Stringent conditions may also be achieved with the addition of destabilizing agents such as formamide.

Thus nucleic acids that hybridize under high stringency to the nucleic acids identified in the figures, or their complements, are considered CA sequences. High stringency conditions are known in the art; see for example Maniatis et al., Molecular Cloning: A Laboratory Manual, 2d Edition, 1989, and Short Protocols in Molecular Biology, ed. Ausubel, et al., both of which are hereby incorporated by reference. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Acid Probes, "Overview of principles of hybridization and the strategy of nucleic acid assays" (1993). Generally, stringent conditions are selected to be about 5-10° C. lower than the thermal melting point ($T_m$) for the specific sequence at a defined ionic strength pH. The $T_m$ is the temperature (under defined ionic strength, pH and nucleic acid concentration) at which 50% of the probes complementary to the target hybridize to the target sequence at equilibrium (as the target sequences are present in excess, at $T_m$, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g. 10 to 50 nucleotides) and at least about 60° C. for longer probes (e.g. greater than 50 nucleotides). In another embodiment, less stringent hybridization conditions are used; for example, moderate or low stringency conditions may be used, as are known in the art; see Maniatis and Ausubel, supra, and Tijssen, supra.

In addition, the CA nucleic acid sequences of the invention are fragments of larger genes, i.e. they are nucleic acid segments. Alternatively, the CA nucleic acid sequences can serve as indicators of oncogene position, for example, the CA sequence may be an enhancer that activates a protooncogene. "Genes" in this context includes coding regions, non-coding regions, and mixtures of coding and non-coding regions.

Accordingly, as will be appreciated by those in the art, using the sequences provided herein, additional sequences of the CA genes can be obtained, using techniques well known in the art for cloning either longer sequences or the full-length sequences; see Maniatis et al., and Ausubel, et al., supra, hereby expressly incorporated by reference. In general, this is done using PCR, for example, kinetic PCR.

Detection of CA Expression

Once the CA nucleic acid is identified, it can be cloned and, if necessary, its constituent parts recombined to form the entire CA nucleic acid. Once isolated from its natural source, e.g., contained within a plasmid or other vector or excised therefrom as a linear nucleic acid segment, the recombinant CA nucleic acid can be further used as a probe to identify and isolate other CA nucleic acids, for example additional coding regions. It can also be used as a "precursor" nucleic acid to make modified or variant CA nucleic acids and proteins. In a preferred embodiment, once a CA gene is identified its nucleotide sequence is used to design probes specific for the CA gene.

The CA nucleic acids of the present invention are used in several ways. In a first embodiment, nucleic acid probes hybridizable to CA nucleic acids are made and attached to biochips to be used in screening and diagnostic methods, or for gene therapy and/or antisense applications. Alternatively, the CA nucleic acids that include coding regions of CA proteins can be put into expression vectors for the expression of CA proteins, again either for screening purposes or for administration to a patient.

Recent developments in DNA microarray technology make it possible to conduct a large scale assay of a plurality of target CA nucleic acid molecules on a single solid phase support. U.S. Pat. No. 5,837,832 (Chee et al.) and related patent applications describe immobilizing an array of oligonucleotide probes for hybridization and detection of specific nucleic acid sequences in a sample. Target polynucleotides of interest isolated from a tissue of interest are hybridized to the DNA chip and the specific sequences detected based on the target polynucleotides preference and degree of hybridization at discrete probe locations. One important use of arrays is in the analysis of differential gene expression, where the profile of expression of genes in different cells, often a cell of interest and a control cell, is compared and any differences in gene expression among the respective cells are identified. Such information is useful for the identification of the types of genes expressed in a particular cell or tissue type and diagnosis of cancer conditions based on the expression profile.

Typically, RNA from the sample of interest is subjected to reverse transcription to obtain labeled cDNA. See U.S. Pat. No. 6,410,229 (Lockhart et al.) The cDNA is then hybridized to oligonucleotides or cDNAs of known sequence arrayed on a chip or other surface in a known order. The location of the oligonucleotide to which the labeled cDNA hybridizes provides sequence information on the cDNA, while the amount of labeled hybridized RNA or cDNA provides an estimate of the relative representation of the RNA or cDNA of interest. See Schena, et al. Science 270:467-470 (1995). For example, use of a cDNA microarray to analyze gene expression patterns in human cancer is described by DeRisi, et al. (Nature Genetics 14:457-460 (1996)).

In a preferred embodiment, nucleic acid probes corresponding to CA nucleic acids (both the nucleic acid sequences outlined in the figures and/or the complements thereof) are made. Typically, these probes are synthesized based on the disclosed sequences of this invention. The nucleic acid probes attached to the biochip are designed to be substantially complementary to the CA nucleic acids, i.e. the target sequence (either the target sequence of the sample or to other probe sequences, for example in sandwich assays), such that specific hybridization of the target sequence and the probes of the present invention occurs. As outlined below, this complementarity need not be perfect, in that there may be any number of base pair mismatches that will interfere with hybridization between the target sequence and the single stranded nucleic acids of the present invention. It is expected that the overall homology of the genes at the nucleotide level probably will be about 40% or greater, probably about 60% or greater, and even more probably about 80% or greater; and in addition that there will be corresponding contiguous sequences of about 8-12 nucleotides or longer. However, if the number of mutations is so great that no hybridization can occur under even the least stringent of hybridization conditions, the sequence is not a complementary target sequence. Thus, by "substantially complementary" herein is meant that the probes are sufficiently complementary to the target sequences to hybridize under normal reaction conditions, particularly high stringency conditions, as outlined herein. Whether or not a sequence is unique to a CA gene according to this invention can be determined by techniques known to those of skill in the art. For example, the sequence can be compared to sequences in databanks, e.g., GeneBank, to determine whether it is present in the uninfected host or other organisms. The sequence can also be compared to the known sequences of other viral agents, including those that are known to induce cancer.

A nucleic acid probe is generally single stranded but can be partly single and partly double stranded. The strandedness of the probe is dictated by the structure, composition, and properties of the target sequence. In general, the oligonucleotide probes range from about 6, 8, 10, 12, 15, 20, 30 to about 100 bases long, with from about 10 to about 80 bases being preferred, and from about 30 to about 50 bases being particularly preferred. That is, generally entire genes are rarely used as probes. In some embodiments, much longer nucleic acids can be used, up to hundreds of bases. The probes are sufficiently specific to hybridize to complementary template sequence under conditions known by those of skill in the art. The number of mismatches between the probes sequences and their complementary template (target) sequences to which they hybridize during hybridization generally do not exceed 15%, usually do not exceed 10% and preferably do not exceed 5%, as determined by FASTA (default settings).

Oligonucleotide probes can include the naturally-occurring heterocyclic bases normally found in nucleic acids (uracil, cytosine, thymine, adenine and guanine), as well as modified bases and base analogues. Any modified base or base analogue compatible with hybridization of the probe to a target sequence is useful in the practice of the invention. The sugar or glycoside portion of the probe can comprise deoxyribose, ribose, and/or modified forms of these sugars, such as, for example, 2'-O-alkyl ribose. In a preferred embodiment, the sugar moiety is 2'-deoxyribose; however, any sugar moiety that is compatible with the ability of the probe to hybridize to a target sequence can be used.

In one embodiment, the nucleoside units of the probe are linked by a phosphodiester backbone, as is well known in the art. In additional embodiments, internucleotide linkages can include any linkage known to one of skill in the art that is compatible with specific hybridization of the probe including, but not limited to phosphorothioate, methylphosphonate, sulfamate (e.g., U.S. Pat. No. 5,470,967) and polyamide (i.e., peptide nucleic acids). Peptide nucleic acids are described in Nielsen et al. (1991) *Science* 254: 1497-1500, U.S. Pat. No. 5,714,331, and Nielsen (1999) *Curr. Opin. Biotechnol.* 10:71-75.

In certain embodiments, the probe can be a chimeric molecule; i.e., can comprise more than one type of base or sugar subunit, and/or the linkages can be of more than one type within the same primer. The probe can comprise a moiety to facilitate hybridization to its target sequence, as are known in the art, for example, intercalators and/or minor groove binders. Variations of the bases, sugars, and internucleoside backbone, as well as the presence of any pendant group on the probe, will be compatible with the ability of the probe to bind, in a sequence-specific fashion, with its target sequence. A large number of structural modifications, both known and to be developed, are possible within these bounds. Advantageously, the probes according to the present invention may have structural characteristics such that they allow the signal amplification, such structural characteristics being, for example, branched DNA probes as those described by Urdea et al. (Nucleic Acids Symp. Ser., 24:197-200 (1991)) or in the European Patent No. EP-0225,807. Moreover, synthetic methods for preparing the various heterocyclic bases, sugars, nucleosides and nucleotides that form the probe, and preparation of oligonucleotides of specific predetermined sequence, are well-developed and known in the art. A preferred method for oligonucleotide synthesis incorporates the teaching of U.S. Pat. No. 5,419,966.

Multiple probes may be designed for a particular target nucleic acid to account for polymorphism and/or secondary structure in the target nucleic acid, redundancy of data and the like. In some embodiments, where more than one probe per sequence is used, either overlapping probes or probes to different sections of a single target CA gene are used. That is, two, three, four or more probes, with three being preferred, are used to build in a redundancy for a particular target. The probes can be overlapping (i.e. have some sequence in common), or specific for distinct sequences of a CA gene. When multiple target polynucleotides are to be detected according to the present invention, each probe or probe group corresponding to a particular target polynucleotide is situated in a discrete area of the microarray.

Probes may be in solution, such as in wells or on the surface of a micro-array, or attached to a solid support. Examples of solid support materials that can be used include a plastic, a ceramic, a metal, a resin, a gel and a membrane. Useful types of solid supports include plates, beads, magnetic material, microbeads, hybridization chips, membranes, crystals, ceramics and self-assembling monolayers. A preferred embodiment comprises a two-dimensional or three-dimensional matrix, such as a gel or hybridization chip with multiple probe binding sites (Pevzner et al., J. Biomol. Struc. & Dyn. 9:399-410, 1991; Maskos and Southern, Nuc. Acids Res. 20:1679-84, 1992). Hybridization chips can be used to construct very large probe arrays that are subsequently hybridized with a target nucleic acid. Analysis of the hybridization pattern of the chip can assist in the identification of the target nucleotide sequence. Patterns can be manually or computer analyzed, but it is clear that positional sequencing by hybridization lends itself to computer analysis and automation. Algorithms and software, which have been developed for sequence reconstruction, are applicable to the methods described herein (R. Drmanac et al., J. Biomol. Struc. & Dyn. 5:1085-1102, 1991; P. A. Pevzner, J. Biomol. Struc. & Dyn. 7:63-73, 1989).

As will be appreciated by those in the art, nucleic acids can be attached or immobilized to a solid support in a wide variety of ways. By "immobilized" herein is meant the association or binding between the nucleic acid probe and the solid support is sufficient to be stable under the conditions of binding, washing, analysis, and removal as outlined below. The binding can be covalent or non-covalent. By "non-covalent binding" and grammatical equivalents herein is meant one or more of either electrostatic, hydrophilic, and hydrophobic interactions. Included in non-covalent binding is the covalent attachment of a molecule, such as streptavidin, to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilization may also involve a combination of covalent and non-covalent interactions.

Nucleic acid probes may be attached to the solid support by covalent binding such as by conjugation with a coupling agent or by, covalent or non-covalent binding such as electrostatic interactions, hydrogen bonds or antibody-antigen coupling, or by combinations thereof. Typical coupling agents include biotin/avidin, biotin/streptavidin, Staphylococcus aureus protein A/IgG antibody $F_c$ fragment, and streptavidin/protein A chimeras (T. Sano and C. R. Cantor, Bio/Technology 9:1378-81 (1991)), or derivatives or combinations of these agents. Nucleic acids may be attached to the solid support by a photocleavable bond, an electrostatic bond, a disulfide bond, a peptide bond, a diester bond or a combination of these sorts of bonds. The array may also be attached to the solid support by a selectively releasable bond such as 4,4'-dimethoxytrityl or its derivative. Derivatives which have been found to be useful include 3 or 4[bis-(4-methoxyphenyl)]-methyl-benzoic acid, N-succinimidyl-3 or 4[bis-(4-methoxyphenyl)]-methyl-benzoic acid, N-succinimidyl-3 or 4[bis-(4-methoxyphenyl)]-hydroxymethyl-benzoic acid, N-succinimidyl-3 or 4[bis-(4-methoxyphenyl)]-chloromethyl-benzoic acid, and salts of these acids.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid substrate. By "substrate" or "solid support" or other grammatical equivalents herein is meant any material that can be modified to contain discrete individual sites appropriate for the attachment or association of the nucleic acid probes and is amenable to at least one detection method. The solid phase support of the present invention can be of any solid materials and structures suitable for supporting nucleotide hybridization and synthesis. Preferably, the solid phase support comprises at least one substantially rigid surface on which the primers can be immobilized and the reverse transcriptase reaction performed. The substrates with which the polynucleotide microarray elements are stably associated may be fabricated from a variety of materials, including plastics, ceramics, metals, acrylamide, cellulose, nitrocellulose, glass, polystyrene, polyethylene vinyl acetate, polypropylene, polymethacrylate, polyethylene, polyethylene oxide, polysilicates, polycarbonates, Teflon®, fluorocarbons, nylon, silicon rubber, polyanhydrides, polyglycolic acid, polylactic acid, polyorthoesters, polypropylfumerate, collagen, glycosaminoglycans, and polyamino acids. Substrates may be two-dimensional or three-dimensional in form, such as gels, membranes, thin films, glasses, plates, cylinders, beads, magnetic beads, optical fibers, woven fibers, etc. A preferred form of array is a three-dimensional array. A preferred three-dimensional array is a collection of tagged beads. Each tagged bead has different primers attached to it. Tags are detectable by signaling means such as color (Luminex, Illumina) and electromagnetic field (Pharmaseq) and signals on tagged beads can even be remotely detected (e.g., using optical fibers). The size of the solid support can be any of the standard microarray sizes, useful for DNA microarray technology, and the size may be tailored to fit the particular machine being used to conduct a reaction of the invention. In general, the substrates allow optical detection and do not appreciably fluoresce.

In a preferred embodiment, the surface of the biochip and the probe may be derivatized with chemical functional groups for subsequent attachment of the two. Thus, for example, the biochip is derivatized with a chemical functional group including, but not limited to, amino groups, carboxy groups, oxo groups and thiol groups, with amino groups being particularly preferred. Using these functional groups, the probes can be attached using functional groups on the probes. For example, nucleic acids containing amino groups can be attached to surfaces comprising amino groups, for example using linkers as are known in the art; for example, homo- or hetero-bifunctional linkers as are well known (see 1994 Pierce Chemical Company catalog, technical section on cross-linkers, pages 155-200, incorporated herein by reference). In addition, in some cases, additional linkers, such as alkyl groups (including substituted and heteroalkyl groups) may be used.

In this embodiment, the oligonucleotides are synthesized as is known in the art, and then attached to the surface of the solid support. As will be appreciated by those skilled in the art, either the 5' or 3' terminus may be attached to the solid support, or attachment may be via an internal nucleoside. In an additional embodiment, the immobilization to the solid support may be very strong, yet non-covalent. For example, biotinylated oligonucleotides can be made, which bind to surfaces covalently coated with streptavidin, resulting in attachment.

The arrays may be produced according to any convenient methodology, such as preforming the polynucleotide microarray elements and then stably associating them with the surface. Alternatively, the oligonucleotides may be synthesized on the surface, as is known in the art. A number of different array configurations and methods for their production are known to those of skill in the art and disclosed in WO 95/25116 and WO 95/35505 (photolithographic techniques), U.S. Pat. No. 5,445,934 (in situ synthesis by photolithography), U.S. Pat. No. 5,384,261 (in situ synthesis by mechanically directed flow paths); and U.S. Pat. No. 5,700,637 (synthesis by spotting, printing or coupling); the disclosure of which are herein incorporated in their entirety by reference. Another method for coupling DNA to beads uses specific ligands attached to the end of the DNA to link to ligand-binding molecules attached to a bead. Possible ligand-binding partner pairs include biotin-avidin/streptavidin, or various antibody/antigen pairs such as digoxygenin-antidigoxygenin antibody (Smith et al., "Direct Mechanical Measurements of the Elasticity of Single DNA Molecules by Using Magnetic Beads," Science 258:1122-1126 (1992)). Covalent chemical attachment of DNA to the support can be accomplished by using standard coupling agents to link the 5'-phosphate on the DNA to coated microspheres through a phosphoamidate bond. Methods for immobilization of oligonucleotides to solid-state substrates are well established. See Pease et al., Proc. Natl. Acad. Sci. USA 91(11):5022-5026 (1994). A preferred method of attaching oligonucleotides to solid-state substrates is described by Guo et al., Nucleic Acids Res. 22:5456-5465 (1994). Immobilization can be accomplished either by in situ DNA synthesis (Maskos and Southern, Nucleic Acids Research, 20:1679-1684 (1992) or by covalent attachment of chemically synthesized oligonucleotides (Guo et al., supra) in combination with robotic arraying technologies.

In addition to the solid-phase technology represented by biochip arrays, gene expression can also be quantified using liquid-phase arrays. One such system is kinetic polymerase chain reaction (PCR). Kinetic PCR allows for the simultaneous amplification and quantification of specific nucleic acid sequences. The specificity is derived from synthetic oligonucleotide primers designed to preferentially adhere to single-stranded nucleic acid sequences bracketing the target site. This pair of oligonucleotide primers form specific, non-covalently bound complexes on each strand of the target sequence. These complexes facilitate in vitro transcription of double-stranded DNA in opposite orientations. Temperature cycling of the reaction mixture creates a continuous cycle of primer binding, transcription, and re-melting of the nucleic acid to individual strands. The result is an exponential increase of the target dsDNA product. This product can be quantified in real time either through the use of an intercalating dye or a sequence specific probe. SYBR® Greene I, is an example of an intercalating dye, that preferentially binds to dsDNA resulting in a concomitant increase in the fluorescent signal. Sequence specific probes, such as used with TaqMan® technology, consist of a fluorochrome and a quenching molecule covalently bound to opposite ends of an oligonucleotide. The probe is designed to selectively bind the target DNA sequence between the two primers. When the DNA strands are synthesized during the PCR reaction, the fluorochrome is cleaved from the probe by the exonuclease activity of the polymerase resulting in signal dequenching. The probe signaling method can be more specific than the intercalating dye method, but in each case, signal strength is proportional to the dsDNA product produced. Each type of quantification method can be used in multi-well liquid phase arrays with each well representing primers and/or probes specific to nucleic acid sequences of interest. When used with messenger RNA preparations of tissues or cell lines, an array of probe/primer reactions can simultaneously quantify the expression of multiple gene products of interest. See Germer, S., et al., Genome Res. 10:258-266 (2000); Heid, C. A., et al., Genome Res. 6, 986-994 (1996).

Expression of CA Proteins

In a preferred embodiment, CA nucleic acids encoding CA proteins are used to make a variety of expression vectors to express CA proteins which can then be used in screening assays, as described below. The expression vectors may be either self-replicating extrachromosomal vectors or vectors which integrate into a host genome. Generally, these expression vectors include transcriptional and translational regulatory nucleic acid operably linked to the nucleic acid encoding the CA protein. The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, synthetic oligonucleotide adaptors or linkers are used in accordance with conventional practice. The transcriptional and translational regulatory nucleic acid will generally be appropriate to the host cell used to express the CA protein; for example, transcriptional and translational regulatory nucleic acid sequences from *Bacillus* are preferably used to express the CA protein in *Bacillus*. Numerous types of appropriate expression vectors, and suitable regulatory sequences are known in the art for a variety of host cells.

In general, the transcriptional and translational regulatory sequences may include, but are not limited to, promoter sequences, ribosomal binding sites, transcriptional start and stop sequences, translational start and stop sequences, and enhancer or activator sequences. In a preferred embodiment, the regulatory sequences include a promoter and transcriptional start and stop sequences.

Promoter sequences encode either constitutive or inducible promoters. The promoters may be either naturally occurring promoters or hybrid promoters. Hybrid promoters, which combine elements of more than one promoter, are also known in the art, and are useful in the present invention.

In addition, the expression vector may comprise additional elements. For example, the expression vector may have two replication systems, thus allowing it to be maintained in two organisms, for example in mammalian or insect cells for expression and in a prokaryotic host for cloning and amplification. Furthermore, for integrating expression vectors, the expression vector contains at least one sequence homologous to the host cell genome, and preferably two homologous sequences that flank the expression construct. The integrating vector may be directed to a specific locus in the host cell by selecting the appropriate homologous sequence for inclusion in the vector. Constructs for integrating vectors are well known in the art.

In addition, in a preferred embodiment, the expression vector contains a selectable marker gene to allow the selection of transformed host cells. Selection genes are well known in the art and will vary with the host cell used.

The CA proteins of the present invention are produced by culturing a host cell transformed with an expression vector containing nucleic acid encoding a CA protein, under the appropriate conditions to induce or cause expression of the CA protein. The conditions appropriate for CA protein expression will vary with the choice of the expression vector and the host cell, and will be easily ascertained by one skilled in the art through routine experimentation. For example, the use of constitutive promoters in the expression vector will require optimizing the growth and proliferation of the host cell, while the use of an inducible promoter requires the appropriate growth conditions for induction. In addition, in some embodiments, the timing of the harvest is important. For example, the baculoviral systems used in insect cell expression are lytic viruses, and thus harvest time selection can be crucial for product yield.

Appropriate host cells include yeast, bacteria, archaebacteria, fungi, and insect, plant and animal cells, including mammalian cells. Of particular interest are *Drosophila melanogaster* cells, *Saccharomyces cerevisiae* and other yeasts, *E. coli, Bacillus subtilis*, Sf9 cells, C129 cells, 293 cells, *Neurospora*, BHK, CHO, COS, HeLa cells, THP1 cell line (a macrophage cell line) and human cells and cell lines.

In a preferred embodiment, the CA proteins are expressed in mammalian cells. Mammalian expression systems are also known in the art, and include retroviral systems. A preferred expression vector system is a retroviral vector system such as is generally described in PCT/US97/01019 and PCT/US97/01048, both of which are hereby expressly incorporated by reference. Of particular use as mammalian promoters are the promoters from mammalian viral genes, since the viral genes are often highly expressed and have a broad host range. Examples include the SV40 early promoter, mouse mammary tumor virus LTR promoter, adenovirus major late promoter, herpes simplex virus promoter, and the CMV promoter. Typically, transcription termination and polyadenylation sequences recognized by mammalian cells are regulatory regions located 3' to the translation stop codon and thus, together with the promoter elements, flank the coding sequence. Examples of transcription terminator and polyadenylation signals include those derived form SV40.

The methods of introducing exogenous nucleic acid into mammalian hosts, as well as other hosts, are well known in the art, and will vary with the host cell used. Techniques include dextran-mediated transfection, calcium phosphate precipitation, polybrene mediated transfection, protoplast fusion, electroporation, viral infection, encapsulation of the polynucleotide(s) in liposomes, and direct microinjection of the DNA into nuclei.

In a preferred embodiment, CA proteins are expressed in bacterial systems. Bacterial expression systems are well known in the art. Promoters from bacteriophage may also be used and are known in the art. In addition, synthetic promoters and hybrid promoters are also useful; for example, the tac promoter is a hybrid of the trp and lac promoter sequences. Furthermore, a bacterial promoter can include naturally occurring promoters of non-bacterial origin that have the ability to bind bacterial RNA polymerase and initiate transcription. In addition to a functioning promoter sequence, an efficient ribosome binding site is desirable. The expression vector may also include a signal peptide sequence that provides for secretion of the CA protein in bacteria. The protein is either secreted into the growth media (gram-positive bacteria) or into the periplasmic space, located between the inner and outer membrane of the cell (gram-negative bacteria). The bacterial expression vector may also include a selectable marker gene to allow for the selection of bacterial strains that have been transformed. Suitable selection genes include genes that render the bacteria resistant to drugs such as ampicillin, chloramphenicol, erythromycin, kanamycin, neomycin and tetracycline. Selectable markers also include biosynthetic genes, such as those in the histidine, tryptophan and leucine biosynthetic pathways. These components are assembled into expression vectors. Expression vectors for bacteria are well known in the art, and include vectors for *Bacillus subtilis, E. coli, Streptococcus cremoris*, and *Streptococcus lividans*, among others. The bacterial expression vectors are transformed into bacterial host cells using techniques well known in the art, such as calcium chloride treatment, electroporation, and others.

In one embodiment, CA proteins are produced in insect cells. Expression vectors for the transformation of insect cells, and in particular, baculovirus-based expression vectors, are well known in the art.

In a preferred embodiment, CA protein is produced in yeast cells. Yeast expression systems are well known in the art, and include expression vectors for *Saccharomyces cerevisiae*, *Candida albicans* and *C. maltosa*, *Hansenula polymorpha*, *Kluyveromyces fragilis* and *K. lactis*, *Pichia guillerimondii* and *P. pastoris*, *Schizosaccharomyces pombe*, and *Yarrowia lipolytica*.

The CA protein may also be made as a fusion protein, using techniques well known in the art. Thus, for example, for the creation of monoclonal antibodies. If the desired epitope is small, the CA protein may be fused to a carrier protein to form an immunogen. Alternatively, the CA protein may be made as a fusion protein to increase expression, or for other reasons. For example, when the CA protein is a CA peptide, the nucleic acid encoding the peptide may be linked to other nucleic acid for expression purposes.

In one embodiment, the CA nucleic acids, proteins and antibodies of the invention are labeled. By "labeled" herein is meant that a compound has at least one element, isotope or chemical compound attached to enable the detection of the compound. In general, labels fall into three classes: a) isotopic labels, which may be radioactive or heavy isotopes; b) immune labels, which may be antibodies or antigens; and c) colored or fluorescent dyes. The labels may be incorporated into the CA nucleic acids, proteins and antibodies at any position. For example, the label should be capable of producing, either directly or indirectly, a detectable signal. The detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the label may be employed, including those methods described by Hunter et al., Nature, 144:945 (1962); David et al., Biochemistry, 13:1014 (1974); Pain et al., J. Immunol. Meth., 40:219 (1981); and Nygren, J. Histochem. and Cytochem., 30:407 (1982).

Accordingly, the present invention also provides CA protein sequences. A CA protein of the present invention may be identified in several ways. "Protein" in this sense includes proteins, polypeptides, and peptides. As will be appreciated by those in the art, the nucleic acid sequences of the invention can be used to generate protein sequences. There are a variety of ways to do this, including cloning the entire gene and verifying its frame and amino acid sequence, or by comparing it to known sequences to search for homology to provide a frame, assuming the CA protein has homology to some protein in the database being used. Generally, the nucleic acid sequences are input into a program that will search all three frames for homology. This is done in a preferred embodiment using the following NCBI Advanced BLAST parameters. The program is blastx or blastn. The database is nr. The input data is as "Sequence in FASTA format". The organism list is "none". The "expect" is 10; the filter is default. The "descriptions" is 500, the "alignments" is 500, and the "alignment view" is pairwise. The "query Genetic Codes" is standard (1). The matrix is BLOSUM 62; gap existence cost is 11, per residue gap cost is 1; and the lambda ratio is 0.85 default. This results in the generation of a putative protein sequence.

In general, the term "polypeptide" as used herein refers to both the full-length polypeptide encoded by the recited polynucleotide, the polypeptide encoded by the gene represented by the recited polynucleotide, as well as portions or fragments thereof. The present invention encompasses variants of the naturally occurring proteins, wherein such variants are homologous or substantially similar to the naturally occurring protein, and can be of an origin of the same or different species as the naturally occurring protein (e.g., human, murine, or some other species that naturally expresses the recited polypeptide, usually a mammalian species). In general, variant polypeptides have a sequence that has at least about 80%, at least about 81%, at least about 82%, at least about 83%, at least about 84%, at least about 85%, at least about 86%, at least about 87%, at least about 88%, at least about 89%, usually at least about 90%, at least 91%, at least 92%, at least 93%, at least 94%, at least 95%, at least 96%, at least 97%, at least 98% and more usually at least about 99% sequence identity with a differentially expressed polypeptide described herein, as determined by the Smith-Waterman homology search algorithm using an affine gap search with a gap open penalty of 12 and a gap extension penalty of 2, BLOSUM matrix of 62. The Smith-Waterman homology search algorithm is taught in Smith and Waterman, *Adv. Appl. Math.* (1981) 2: 482-489. The variant polypeptides can be naturally or non-naturally glycosylated, i.e., the polypeptide has a glycosylation pattern that differs from the glycosylation pattern found in the corresponding naturally occurring protein.

Also within the scope of the invention are variants. Variants of polypeptides include mutants, fragments, and fusions. Mutants can include amino acid substitutions, additions or deletions. The amino acid substitutions can be conservative amino acid substitutions or substitutions to eliminate non-essential amino acids, such as to alter a glycosylation site, a phosphorylation site or an acetylation site, or to minimize misfolding by substitution or deletion of one or more cysteine residues that are not necessary for function. Conservative amino acid substitutions are those that preserve the general charge, hydrophobicity/hydrophilicity, and/or steric bulk of the amino acid substituted. Variants can be designed so as to retain or have enhanced biological activity of a particular region of the protein (e.g., a functional domain and/or, where the polypeptide is a member of a protein family, a region associated with a consensus sequence). Selection of amino acid alterations for production of variants can be based upon the accessibility (interior vs. exterior) of the amino acid (see, e.g., Go et al, *Int. J. Peptide Protein Res.* (1980) 15:211), the thermostability of the variant polypeptide (see, e.g., Querol et al., *Prot. Eng.* (1996) 9:265), desired glycosylation sites (see, e.g., Olsen and Thomsen, *J. Gen. Microbiol.* (1991) 137:579), desired disulfide bridges (see, e.g., Clarke et al., *Biochemistry* (1993) 32:4322; and Wakarchuk et al., *Protein Eng.* (1994) 7:1379), desired metal binding sites (see, e.g., Toma et al., *Biochemistry* (1991) 30:97, and Haezerbrouck et al., *Protein Eng.* (1993) 6:643), and desired substitutions within proline loops (see, e.g., Masul et al., *Appl. Env. Microbiol.* (1994) 60:3579). Cysteine-depleted muteins can be produced as disclosed in U.S. Pat. No. 4,959,314.

Variants also include fragments of the polypeptides disclosed herein, particularly biologically active fragments and/or fragments corresponding to functional domains. Fragments of interest will typically be at least about 8 amino acids (aa) 10 aa, 15 aa, 20 aa, 25 aa, 30 aa, 35 aa, 40 aa, to at least about 45 aa in length, usually at least about 50 aa in length, at least about 75 aa, at least about 100 aa, at least about 125 aa, at least about 150 aa in length, at least about 200 aa, at least about 300 aa, at least about 400 aa and can be as long as 500 aa in length or longer, but will usually not exceed about 1000 aa in length, where the fragment will have a stretch of amino acids that is identical to a polypeptide encoded by a polynucleotide having a sequence of any one of the polynucleotide sequences provided herein, or a homolog thereof. The protein variants described herein are encoded by polynucleotides that are within the scope of the invention. The genetic code can be used to select the appropriate codons to construct the corresponding variants.

While altered expression of the polynucleotides associated with cancer is observed, altered levels of expression of the polypeptides encoded by these polynucleotides may likely play a role in cancers.

Also included within one embodiment of CA proteins are amino acid variants of the naturally occurring sequences, as determined herein. Preferably, the variants are preferably greater than about 75% homologous to the wild-type sequence, more preferably greater than about 80%, even more preferably greater than about 85% and most preferably greater than 90%. The present application is also directed to proteins containing polypeptides at least 80%, 85%, 90%, 95%, 96%, 97%, 98% or 99% identical to a CA polypeptide sequence set forth herein. As for nucleic acids, homology in this context means sequence similarity or identity, with identity being preferred. This homology will be determined using standard techniques known in the art as are outlined above for the nucleic acid homologies.

CA proteins of the present invention may be shorter or longer than the wild type amino acid sequences. Thus, in a preferred embodiment, included within the definition of CA proteins are portions or fragments of the wild type sequences herein. In addition, as outlined above, the CA nucleic acids of the invention may be used to obtain additional coding regions, and thus additional protein sequence, using techniques known in the art.

In a preferred embodiment, the CA proteins are derivative or variant CA proteins as compared to the wild-type sequence. That is, as outlined more fully below, the derivative CA peptide will contain at least one amino acid substitution, deletion or insertion, with amino acid substitutions being particularly preferred. The amino acid substitution, insertion or deletion may occur at any residue within the CA peptide.

Also included in an embodiment of CA proteins of the present invention are amino acid sequence variants. These variants fall into one or more of three classes: substitutional, insertional or deletional variants. These variants ordinarily are prepared by site-specific mutagenesis of nucleotides in the DNA encoding the CA protein, using cassette or PCR mutagenesis or other techniques well known in the art, to produce DNA encoding the variant, and thereafter expressing the DNA in recombinant cell culture as outlined above. However, variant CA protein fragments having up to about 100-150 residues may be prepared by in vitro synthesis using established techniques. Amino acid sequence variants are characterized by the predetermined nature of the variation, a feature that sets them apart from naturally occurring allelic or interspecies variation of the CA protein amino acid sequence. The variants typically exhibit the same qualitative biological activity as the naturally occurring analogue, although variants can also be selected which have modified characteristics as will be more fully outlined below.

While the site or region for introducing an amino acid sequence variation is predetermined, the mutation per se need not be predetermined. For example, in order to optimize the performance of a mutation at a given site, random mutagenesis may be conducted at the target codon or region and the expressed CA variants screened for the optimal combination of desired activity. Techniques for making substitution mutations at predetermined sites in DNA having a known sequence are well known, for example, M13 primer mutagenesis and LAR mutagenesis. Screening of the mutants is done using assays of CA protein activities.

Amino acid substitutions are typically of single residues; insertions usually will be on the order of from about 1 to 20 amino acids, although considerably larger insertions may be tolerated. Deletions range from about 1 to about 20 residues, although in some cases deletions may be much larger.

Substitutions, deletions, insertions or any combination thereof may be used to arrive at a final derivative. Generally these changes are done on a few amino acids to minimize the alteration of the molecule. However, larger changes may be tolerated in certain circumstances. When small alterations in the characteristics of the CA protein are desired, substitutions are generally made in accordance with the following chart:

CHART 1

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

Substantial changes in function or immunological identity are made by selecting substitutions that are less conservative than those shown in Chart I. For example, substitutions may be made full length to more significantly affect one or more of the following: the structure of the polypeptide backbone in the area of the alteration (e.g., the alpha-helical or beta-sheet structure); the charge or hydrophobicity of the molecule at the target site; and the bulk of the side chain. The substitutions which in general are expected to produce the greatest changes in the polypeptide's properties are those in which (a) a hydrophilic residue, e.g. seryl or threonyl is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine.

The variants typically exhibit the same qualitative biological activity and will elicit the same immune response as the naturally-occurring analogue, although variants also are selected to modify the characteristics of the CA proteins as needed. Alternatively, the variant may be designed such that the biological activity of the CA protein is altered. For example, glycosylation sites may be altered or removed, dominant negative mutations created, etc.

Covalent modifications of CA polypeptides are included within the scope of this invention, for example for use in screening. One type of covalent modification includes reacting targeted amino acid residues of a CA polypeptide with an organic derivatizing agent that is capable of reacting with selected side chains or the N- or C-terminal residues of a CA polypeptide. Derivatization with bifunctional agents is useful, for instance, for crosslinking CA polypeptides to a water-insoluble support matrix or surface for use in the method for purifying anti-CA antibodies or screening assays, as is more fully described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl, threonyl or tyrosyl residues, methylation of the a-amino groups of lysine, arginine, and histidine side chains [T. E. Creighton, Proteins: Structure and Molecular Properties, W. H. Freeman & Co., San Francisco, pp. 79-86 (1983)], acetylation of the N-terminal amine, and amidation of any C-terminal carboxyl group.

Another type of covalent modification of the CA polypeptide included within the scope of this invention comprises altering the native glycosylation pattern of the polypeptide. "Altering the native glycosylation pattern" is intended for purposes herein to mean deleting one or more carbohydrate moieties found in native sequence CA polypeptide, and/or adding one or more glycosylation sites that are not present in the native sequence CA polypeptide.

Addition of glycosylation sites to CA polypeptides may be accomplished by altering the amino acid sequence thereof. The alteration may be made, for example, by the addition of, or substitution by, one or more serine or threonine residues to the native sequence CA polypeptide (for O-linked glycosylation sites). The CA amino acid sequence may optionally be altered through changes at the DNA level, particularly by mutating the DNA encoding the CA polypeptide at preselected bases such that codons are generated that will translate into the desired amino acids.

Another means of increasing the number of carbohydrate moieties on the CA polypeptide is by chemical or enzymatic coupling of glycosides to the polypeptide. Such methods are described in the art, e.g., in WO 87/05330 published 11 Sep. 1987, and in Aplin and Wriston, L A Crit. Rev. Biochem., pp. 259-306 (1981).

Removal of carbohydrate moieties present on the CA polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., Arch. Biochem. Biophys., 259:52 (1987) and by Edge et al., Anal. Biochem., 118:131 (1981). Enzymatic cleavage of carbohydrate moieties on polypeptides can be achieved by the use of a variety of endo- and exo-glycosidases as described by Thotakura et al., Meth. Enzymol., 138:350 (1987).

Another type of covalent modification of CA comprises linking the CA polypeptide to one of a variety of nonproteinaceous polymers, e.g., polyethylene glycol, polypropylene glycol, or polyoxyalkylenes, in the manner set forth in U.S. Pat. No. 4,640,835; 4,496,689; 4,301,144; 4,670,417; 4,791,192 or 4,179,337.

CA polypeptides of the present invention may also be modified in a way to form chimeric molecules comprising a CA polypeptide fused to another, heterologous polypeptide or amino acid sequence. In one embodiment, such a chimeric molecule comprises a fusion of a CA polypeptide with a tag polypeptide that provides an epitope to which an anti-tag antibody can selectively bind. The epitope tag is generally placed at the amino- or carboxyl-terminus of the CA polypeptide, although internal fusions may also be tolerated in some instances. The presence of such epitope-tagged forms of a CA polypeptide can be detected using an antibody against the tag polypeptide. Also, provision of the epitope tag enables the CA polypeptide to be readily purified by affinity purification using an anti-tag antibody or another type of affinity matrix that binds to the epitope tag. In an alternative embodiment, the chimeric molecule may comprise a fusion of a CA polypeptide with an immunoglobulin or a particular region of an immunoglobulin. For a bivalent form of the chimeric molecule, such a fusion could be to the Fc region of an IgG molecule.

Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., Mol. Cell. Biol., 8:2159-2165 (1988)]; the c-myc tag and the 8F9, 3C7, 6E10, G4, B7 and 9E10 antibodies thereto [Evan et al., Molecular and Cellular Biology, 5:3610-3616 (1985)]; and the Herpes Simplex virus glycoprotein D (gD) tag and its antibody [Paborsky et al., Protein Engineering, 3(6):547-553 (1990)]. Other tag polypeptides include the Flag-peptide [Hopp et al., BioTechnology, 6:1204-1210 (1988)]; the KT3 epitope peptide [Martin et al., Science, 255:192-194 (1992)]; tubulin epitope peptide [Skinner et al., J. Biol. Chem., 266: 15163-15166 (1991)]; and the T7 gene 10 protein peptide tag [Lutz-Freyermuth et al., Proc. Natl. Acad. Sci. USA, 87:6393-6397 (1990)].

Also included with the definition of CA protein in one embodiment are other CA proteins of the CA family, and CA proteins from other organisms, which are cloned and expressed as outlined below. Thus, probe or degenerate polymerase chain reaction (PCR) primer sequences may be used to find other related CA proteins from humans or other organisms. As will be appreciated by those in the art, particularly useful probe and/or PCR primer sequences include the unique areas of the CA nucleic acid sequence. As is generally known in the art, preferred PCR primers are from about 15 to about 35 nucleotides in length, with from about 20 to about 30 being preferred, and may contain inosine as needed. The conditions for the PCR reaction are well known in the art.

In addition, as is outlined herein, CA proteins can be made that are longer than those encoded by the nucleic acids of the figures, for example, by the elucidation of additional sequences, the addition of epitope or purification tags, the addition of other fusion sequences, etc.

CA proteins may also be identified as being encoded by CA nucleic acids. Thus, CA proteins are encoded by nucleic acids that will hybridize to the sequences of the sequence listings, or their complements, as outlined herein.

CA Antigens and Antibodies Thereto

In one embodiment, the invention provides CA specific antibodies. In a preferred embodiment, when the CA protein is to be used to generate antibodies, for example for immunotherapy, the CA protein should share at least one epitope or determinant with the full-length protein. By "epitope" or "determinant" herein is meant a portion of a protein that will generate and/or bind an antibody or T-cell receptor in the context of MHC. Thus, in most instances, antibodies made to a smaller CA protein will be able to bind to the full-length protein. In a preferred embodiment, the epitope is unique; that is, antibodies generated to a unique epitope show little or no cross-reactivity.

Any polypeptide sequence encoded by the CA polynucleotide sequences may be analyzed to determine certain preferred regions of the polypeptide. Regions of high antigenicity are determined from data by DNASTAR analysis by choosing values that represent regions of the polypeptide that are likely to be exposed on the surface of the polypeptide in an environment in which antigen recognition may occur in the process of initiation of an immune response. For example, the amino acid sequence of a polypeptide encoded by a CA polynucleotide sequence may be analyzed using the default parameters of the DNASTAR computer algorithm (DNASTAR, Inc., Madison, Wis.; world wide web at dnastar.com).

Polypeptide features that may be routinely obtained using the DNASTAR computer algorithm include, but are not limited to, Garnier-Robson alpha-regions, beta-regions, turn-regions, and coil-regions (Garnier et al. *J. Mol. Biol.,* 120: 97 (1978)); Chou-Fasman alpha-regions, beta-regions, and turn-regions (*Adv. in Enzymol.,* 47:45-148 (1978)); Kyte-Doolittle hydrophilic regions and hydrophobic regions (*J. Mol. Biol.,* 157:105-132 (1982)); Eisenberg alpha- and beta-amphipathic regions; Karplus-Schulz flexible regions; Emini surface-forming regions (*J. Virol.,* 55(3):836-839 (1985)); and Jameson-Wolf regions of high antigenic index (*CABIOS,* 4(1):181-186 (1988)). Kyte-Doolittle hydrophilic regions and hydrophobic regions, Emini surface-forming regions, and Jameson-Wolf regions of high antigenic index (i.e., containing four or more contiguous amino acids having an antigenic index of greater than or equal to 1.5, as identified using the default parameters of the Jameson-Wolf program) can routinely be used to determine polypeptide regions that exhibit a high degree of potential for antigenicity. One approach for preparing antibodies to a protein is the selection and preparation of an amino acid sequence of all or part of the protein, chemically synthesizing the sequence and injecting it into an appropriate animal, typically a rabbit, hamster or a mouse. Oligopeptides can be selected as candidates for the production of an antibody to the CA protein based upon the oligopeptides lying in hydrophilic regions, which are thus likely to be exposed in the mature protein. Additional oligopeptides can be determined using, for example, the Antigenicity Index, Welling, G. W. et al., *FEBS Lett.* 188:215-218 (1985), incorporated herein by reference.

In one embodiment, the term "antibody" includes antibody fragments, as are known in the art, including Fab, $Fab_2$, single chain antibodies (Fv for example), chimeric antibodies, etc., either produced by the modification of whole antibodies or those synthesized de novo using recombinant DNA technologies.

Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include a protein encoded by a nucleic acid of the figures or fragment thereof or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants that may be employed include Freund's complete adjuvant and MPL-TDM adjuvant (monophosphoryl Lipid A, synthetic trehalose dicorynomycolate). The immunization protocol may be selected by one skilled in the art without undue experimentation.

The antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro. The immunizing agent will typically include a polypeptide encoded by a nucleic acid of Tables 1-27, or fragment thereof or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, Monoclonal Antibodies: Principles and Practice, Academic Press, (1986) pp. 59-103). Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Monoclonal antibody technology is used in implementing research, diagnosis and therapy. Monoclonal antibodies are used in radioimmunoassays, enzyme-linked immunosorbent assays, immunocytopathology, and flow cytometry for in vitro diagnosis, and in vivo for diagnosis and immunotherapy of human disease. Waldmann, T. A. (1991) *Science* 252:1657-1662. In particular, monoclonal antibodies have been widely applied to the diagnosis and therapy of cancer, wherein it is desirable to target malignant lesions while avoiding normal tissue. See, e.g., U.S. Pat. No. 4,753,894 to Frankel, et al.; U.S. Pat. No. 4,938,948 to Ring et al.; and U.S. Pat. No. 4,956,453 to Bjorn et al.

In one embodiment, the antibodies are bispecific antibodies. Bispecific antibodies are monoclonal, preferably human or humanized, antibodies that have binding specificities for at least two different antigens. A number of "humanized" antibody molecules comprising an antigen-binding site derived from a non-human immunoglobulin have been described, including chimeric antibodies having rodent V regions and their associated CDRs fused to human constant domains (Winter et al. (1991) *Nature* 349:293-299; Lobuglio et al. (1989) *Proc. Nat. Acad. Sci. USA* 86:4220-4224; Shaw et al. (1987) *J Immunol.* 138:4534-4538; and Brown et al. (1987) *Cancer Res.* 47:3577-3583), rodent CDRs grafted into a human supporting FR prior to fusion with an appropriate human antibody constant domain (Riechmann et al. (1988) *Nature* 332:323-327; Verhoeyen et al. (1988) *Science* 239: 1534-1536; and Jones et al. (1986) *Nature* 321:522-525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients. In the present case, one of the binding specificities is for a protein encoded by a nucleic acid of Tables 1-27, or a fragment thereof, the other one is for any other antigen, and preferably for a cell-surface protein or receptor or receptor subunit, preferably one that is tumor specific.

In a preferred embodiment, the antibodies to CA are capable of reducing or eliminating the biological function of CA, as is described below. That is, the addition of anti-CA antibodies (either polyclonal or preferably monoclonal) to CA (or cells containing CA) may reduce or eliminate the CA activity. Generally, at least a 25% decrease in activity is preferred, with at least about 50% being particularly preferred and about a 95-100% decrease being especially preferred.

In a preferred embodiment the antibodies to the CA proteins are humanized antibodies. "Humanized" antibodies refer to a molecule having an antigen binding site that is substantially derived from an immunoglobulin from a non-human species and the remaining immunoglobulin structure of the molecule based upon the structure and/or sequence of a human immunoglobulin. The antigen binding site may comprise either complete variable domains fused onto constant domains or only the complementarity determining regions (CDRs) grafted onto appropriate framework regions in the variable domains. Antigen binding sites may be wild type or modified by one or more amino acid substitutions, e.g., modified to resemble human immunoglobulin more closely. Alternatively, a humanized antibody may be derived from a chimeric antibody that retains or substantially retains the antigen-binding properties of the parental, non-human, antibody but which exhibits diminished immunogenicity as compared to the parental antibody when administered to humans. The phrase "chimeric antibody," as used herein, refers to an antibody containing sequence derived from two different antibodies (see, e.g., U.S. Pat. No. 4,816,567) that typically originate from different species. Typically, in these chimeric antibodies, the variable region of both light and heavy chains mimics the variable regions of antibodies derived from one species of mammals, while the constant portions are homologous to the sequences in antibodies derived from another. Most typically, chimeric antibodies comprise human and murine antibody fragments, generally human constant and mouse variable regions. Humanized antibodies include human immunoglobulins (recipient antibody) in which residues form a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues that are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework residues (FR) regions are those of a human immunoglobulin consensus sequence. The humanized antibody optimally also will comprise at least a portion of an immunoglobulin constant region (Fc), typically that of a human immunoglobulin (Jones et al., *Nature*, 321:522-525 (1986); Riechmann et al., *Nature*, 332:323-329 (1988); and Presta, *Curr. Op. Struct. Biol.*, 2:593-596 (1992)). One clear advantage to such chimeric forms is that, for example, the variable regions can conveniently be derived from presently known sources using readily available hybridomas or B cells from non human host organisms in combination with constant regions derived from, for example, human cell preparations. While the variable region has the advantage of ease of preparation, and the specificity is not affected by its source, the constant region being human, is less likely to elicit an immune response from a human subject when the antibodies are injected than would the constant region from a non-human source. However, the definition is not limited to this particular example.

Because humanized antibodies are far less immunogenic in humans than the parental mouse monoclonal antibodies, they can be used for the treatment of humans with far less risk of anaphylaxis. Thus, these antibodies may be preferred in therapeutic applications that involve in vivo administration to a human such as, e.g., use as radiation sensitizers for the treatment of neoplastic disease or use in methods to reduce the side effects of, e.g., cancer therapy. Methods for humanizing non-human antibodies are well known in the art. Generally, a humanized antibody has one or more amino acid residues introduced into it from a source that is non-human. These non-human amino acid residues are often referred to as import residues, which are typically taken from an import variable domain. Humanization can be essentially performed following the method of Winter and co-workers (Jones et al., *Nature* 321:522-525 (1986); Riechmann et al., *Nature* 332:323-327 (1988); Verhoeyen et al., *Science* 239:1534-1536 (1988)), by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.*, 227:381 (1991); Marks et al., *J. Mol. Biol.*, 222:581 (1991)]. The techniques of Cole et al. and Boerner et al. are also available for the preparation of human monoclonal antibodies [Cole et al., Monoclonal Antibodies and Cancer Therapy, Alan R. Liss, p. 77 (1985) and Boerner et al., *J. Immunol.*, 147(1):86-95 (1991)]. Humanized antibodies may be achieved by a variety of methods including, for example: (1) grafting the non-human complementarity determining regions (CDRs) onto a human framework and constant region (a process referred to in the art as "humanizing"), or, alternatively, (2) transplanting the entire non-human variable domains, but "cloaking" them with a human-like surface by replacement of surface residues (a process referred to in the art as "veneering"). In the present invention, humanized antibodies will include both "humanized" and "veneered" antibodies. Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779-783 (1992); Lonberg et al., *Nature* 368 856-859 (1994); Morrison, *Nature* 368, 812-13 (1994); Fishwild et al., *Nature Biotechnology* 14, 845-51 (1996); Neuberger, *Nature Biotechnology* 14, 826 (1996); Lonberg and Huszar, *Intern. Rev. Immunol.* 13 65-93 (1995); Jones et al., *Nature* 321:522-525 (1986); Morrison et al., *Proc. Natl. Acad. Sci, US.A.*, 81:6851-6855 (1984); Morrison and Oi, *Adv. Immunol.*, 44:65-92 (1988); Verhoeyer et al., *Science* 239:1534-1536 (1988); Padlan, *Molec. Immun.* 28:489-498 (1991); Padlan, *Molec. Immunol.* 31(3):169-217

(1994); and Kettleborough, C. A. et al., *Protein Eng.* 4(7): 773-83 (1991) each of which is incorporated herein by reference.

The phrase "complementarity determining region" refers to amino acid sequences which together define the binding affinity and specificity of the natural Fv region of a native immunoglobulin binding site. See, e.g., Chothia et al., *J. Mol. Biol.* 196:901-917 (1987); Kabat et al., U.S. Dept. of Health and Human Services NIH Publication No. 91-3242 (1991). The phrase "constant region" refers to the portion of the antibody molecule that confers effector functions. In the present invention, mouse constant regions are substituted by human constant regions. The constant regions of the subject humanized antibodies are derived from human immunoglobulins. The heavy chain constant region can be selected from any of the five isotypes: alpha, delta, epsilon, gamma or mu. One method of humanizing antibodies comprises aligning the non-human heavy and light chain sequences to human heavy and light chain sequences, selecting and replacing the non-human framework with a human framework based on such alignment, molecular modeling to predict the conformation of the humanized sequence and comparing to the conformation of the parent antibody. This process is followed by repeated back mutation of residues in the CDR region that disturb the structure of the CDRs until the predicted conformation of the humanized sequence model closely approximates the conformation of the non-human CDRs of the parent non-human antibody. Such humanized antibodies may be further derivatized to facilitate uptake and clearance, e.g., via Ashwell receptors. See, e.g., U.S. Pat. Nos. 5,530,101 and 5,585,089 which are incorporated herein by reference.

Humanized antibodies to CA polypeptides can also be produced using transgenic animals that are engineered to contain human immunoglobulin loci. For example, WO 98/24893 discloses transgenic animals having a human Ig locus wherein the animals do not produce functional endogenous immunoglobulins due to the inactivation of endogenous heavy and light chain loci. WO 91/10741 also discloses transgenic non-primate mammalian hosts capable of mounting an immune response to an immunogen, wherein the antibodies have primate constant and/or variable regions, and wherein the endogenous immunoglobulin-encoding loci are substituted or inactivated. WO 96/30498 discloses the use of the Cre/Lox system to modify the immunoglobulin locus in a mammal, such as to replace all or a portion of the constant or variable region to form a modified antibody molecule. WO 94/02602 discloses non-human mammalian hosts having inactivated endogenous Ig loci and functional human Ig loci. U.S. Pat. No. 5,939,598 discloses methods of making transgenic mice in which the mice lack endogenous heavy chains, and express an exogenous immunoglobulin locus comprising one or more xenogeneic constant regions.

Using a transgenic animal described above, an immune response can be produced to a selected antigenic molecule, and antibody-producing cells can be removed from the animal and used to produce hybridomas that secrete human monoclonal antibodies. Immunization protocols, adjuvants, and the like are known in the art, and are used in immunization of, for example, a transgenic mouse as described in WO 96/33735. The monoclonal antibodies can be tested for the ability to inhibit or neutralize the biological activity or physiological effect of the corresponding protein.

In the present invention, CA polypeptides of the invention and variants thereof are used to immunize a transgenic animal as described above. Monoclonal antibodies are made using methods known in the art, and the specificity of the antibodies is tested using isolated CA polypeptides. Methods for preparation of the human or primate CA or an epitope thereof include, but are not limited to chemical synthesis, recombinant DNA techniques or isolation from biological samples. Chemical synthesis of a peptide can be performed, for example, by the classical Merrifeld method of solid phase peptide synthesis (Merrifeld, *J. Am. Chem. Soc.* 85:2149, 1963 which is incorporated by reference) or the FMOC strategy on a Rapid Automated Multiple Peptide Synthesis system (E. I. du Pont de Nemours Company, Wilmington, Del.) (Caprino and Han, *J. Org. Chem.* 37:3404, 1972 which is incorporated by reference).

Polyclonal antibodies can be prepared by immunizing rabbits or other animals by injecting antigen followed by subsequent boosts at appropriate intervals. The animals are bled and sera assayed against purified CA proteins usually by ELISA or by bioassay based upon the ability to block the action of CA proteins. When using avian species, e.g., chicken, turkey and the like, the antibody can be isolated from the yolk of the egg. Monoclonal antibodies can be prepared after the method of Milstein and Kohler by fusing splenocytes from immunized mice with continuously replicating tumor cells such as myeloma or lymphoma cells. (Milstein and Kohler, *Nature* 256:495-497, 1975; Gulfre and Milstein, *Methods in Enzymology: Immunochemical Techniques* 73:1-46, Langone and Banatis eds., Academic Press, 1981 which are incorporated by reference). The hybridoma cells so formed are then cloned by limiting dilution methods and supernates assayed for antibody production by ELISA, RIA or bioassay.

The unique ability of antibodies to recognize and specifically bind to target proteins provides an approach for treating an overexpression of the protein. Thus, another aspect of the present invention provides for a method for preventing or treating diseases involving overexpression of a CA polypeptide by treatment of a patient with specific antibodies to the CA protein.

Specific antibodies, either polyclonal or monoclonal, to the CA proteins can be produced by any suitable method known in the art as discussed above. For example, murine or human monoclonal antibodies can be produced by hybridoma technology or, alternatively, the CA proteins, or an immunologically active fragment thereof, or an anti-idiotypic antibody, or fragment thereof can be administered to an animal to elicit the production of antibodies capable of recognizing and binding to the CA proteins. Such antibodies can be from any class of antibodies including, but not limited to IgG, IgA, IgM, IgD, and IgE or in the case of avian species, IgY and from any subclass of antibodies.

By immunotherapy is meant treatment of a cancer with an antibody raised against a CA protein. As used herein, immunotherapy can be passive or active. Passive immunotherapy as defined herein is the passive transfer of antibody to a recipient (patient). Active immunization is the induction of antibody and/or T-cell responses in a recipient (patient). Induction of an immune response is the result of providing the recipient with an antigen to which antibodies are raised. As appreciated by one of ordinary skill in the art, the antigen may be provided by injecting a polypeptide against which antibodies are desired to be raised into a recipient, or contacting the recipient with a nucleic acid capable of expressing the antigen and under conditions for expression of the antigen.

In a preferred embodiment, oncogenes which encode secreted growth factors may be inhibited by raising antibodies against CA proteins that are secreted proteins as described above. Without being bound by theory, antibodies used for treatment, bind and prevent the secreted protein from binding to its receptor, thereby inactivating the secreted CA protein.

In another preferred embodiment, the CA protein to which antibodies are raised is a transmembrane protein. Without being bound by theory, antibodies used for treatment, bind the extracellular domain of the CA protein and prevent it from binding to other proteins, such as circulating ligands or cell-associated molecules. The antibody may cause down-regulation of the transmembrane CA protein. As will be appreciated by one of ordinary skill in the art, the antibody may be a competitive, non-competitive or uncompetitive inhibitor of protein binding to the extracellular domain of the CA protein. The antibody is also an antagonist of the CA protein. Further, the antibody prevents activation of the transmembrane CA protein. In one aspect, when the antibody prevents the binding of other molecules to the CA protein, the antibody prevents growth of the cell. The antibody may also sensitize the cell to cytotoxic agents, including, but not limited to TNF-$\alpha$, TNF-$\beta$, IL-1, INF-$\gamma$ and IL-2, or chemotherapeutic agents including 5FU, vinblastine, actinomycin D, cisplatin, methotrexate, and the like. In some instances the antibody belongs to a sub-type that activates serum complement when complexed with the transmembrane protein thereby mediating cytotoxicity. Thus, cancers may be treated by administering to a patient antibodies directed against the transmembrane CA protein.

In another preferred embodiment, the antibody is conjugated to a therapeutic moiety. In one aspect the therapeutic moiety is a small molecule that modulates the activity of the CA protein. In another aspect the therapeutic moiety modulates the activity of molecules associated with or in close proximity to the CA protein. The therapeutic moiety may inhibit enzymatic activity such as protease or protein kinase activity associated with cancer.

In a preferred embodiment, the therapeutic moiety may also be a cytotoxic agent. In this method, radioisotopes, natural toxins, chemotherapy agents, or other substances (such as biological response modifiers) are chemically linked or conjugated to a monoclonal antibody to form "immunoconjugates" and "immunotoxins" which target the cytotoxic agent to tumor tissue or cells resulting in a reduction in the number of afflicted cells, thereby reducing symptoms associated with cancers, including lymphoma. Cytotoxic agents are numerous and varied and include, but are not limited to, cytotoxic drugs or toxins or active fragments of such toxins. Suitable toxins and their corresponding fragments include diphtheria A chain, exotoxin A chain, ricin A chain, abrin A chain, curcin, crotin, phenomycin, enomycin and the like. Cytotoxic agents also include radiochemicals made by conjugating radioisotopes to antibodies raised against CA proteins, or binding of a radionuclide to a chelating agent that has been covalently attached to the antibody. Targeting the therapeutic moiety to transmembrane CA proteins not only serves to increase the local concentration of therapeutic moiety in the cancer of interest, i.e., lymphoma, but also serves to reduce deleterious side effects that may be associated with the therapeutic moiety. A number of investigators have used monoclonal antibodies as carriers of cytotoxic substances in attempts to selectively direct those agents to malignant tissue. More particularly, a number of monoclonal antibodies have been conjugated to toxins such as ricin, abrin, diphtheria toxin and *Pseudomonas exotoxin* or to enzymatically active portions (A chains) thereof via heterobifunctional agents. See, e.g., U.S. Pat. No. 4,753,894 to Frankel et al.; Nevelle, et al. (1982) *Immunol Rev* 62:75-91; Ross et al. (1980) *Eur. J Biochem* 104; Vitteta et al. (1982) *Immunol Rev* 62:158-183; Raso et al. (1982) *Cancer Res* 42:457-464, and Trowbridge et al. (1981) *Nature* 294:171-173.

In another preferred embodiment, the CA protein against which the antibodies are raised is an intracellular protein. In this case, the antibody may be conjugated to a protein that facilitates entry into the cell. In one case, the antibody enters the cell by endocytosis. In another embodiment, a nucleic acid encoding the antibody is administered to the individual or cell. Moreover, wherein the CA protein can be targeted within a cell, e.g., the nucleus, an antibody thereto contains a signal for that target localization, e.g., a nuclear localization signal.

The CA antibodies of the invention specifically bind to CA proteins. By "specifically bind" herein is meant that the antibodies bind to the protein with a binding constant in the range of $10^{-1}$-$10^{-6}$ M$^{-1}$, with a preferred range being $10^{-7}$-$10^{-9}$ M$^{-1}$.

In a preferred embodiment, the CA protein is purified or isolated after expression. CA proteins may be isolated or purified in a variety of ways known to those skilled in the art depending on what other components are present in the sample. Standard purification methods include electrophoretic, molecular, immunological and chromatographic techniques, including ion exchange, hydrophobic, affinity, and reverse-phase HPLC chromatography, and chromatofocusing. For example, the CA protein may be purified using a standard anti-CA antibody column. Ultrafiltration and diafiltration techniques, in conjunction with protein concentration, are also useful. For general guidance in suitable purification techniques, see Scopes, R., Protein Purification, Springer-Verlag, N.Y. (1982). The degree of purification necessary will vary depending on the use of the CA protein. In some instances no purification will be necessary.

Detection of Cancer Phenotype

Once expressed and purified if necessary, the CA proteins and nucleic acids are useful in a number of applications. In one aspect, the expression levels of genes are determined for different cellular states in the cancer phenotype; that is, the expression levels of genes in normal tissue and in cancer tissue (and in some cases, for varying severities of lymphoma that relate to prognosis, as outlined below) are evaluated to provide expression profiles. An expression profile of a particular cell state or point of development is essentially a "fingerprint" of the state; while two states may have any particular gene similarly expressed, the evaluation of a number of genes simultaneously allows the generation of a gene expression profile that is unique to the state of the cell. By comparing expression profiles of cells in different states, information regarding which genes are important (including both up- and down-regulation of genes) in each of these states is obtained. Then, diagnosis may be done or confirmed: does tissue from a particular patient have the gene expression profile of normal or cancer tissue.

"Differential expression," or equivalents used herein, refers to both qualitative as well as quantitative differences in the temporal and/or cellular expression patterns of genes, within and among the cells. Thus, a differentially expressed gene can qualitatively have its expression altered, including an activation or inactivation, in, for example, normal versus cancer tissue. That is, genes may be turned on or turned off in a particular state, relative to another state. As is apparent to the skilled artisan, any comparison of two or more states can be made. Such a qualitatively regulated gene will exhibit an expression pattern within a state or cell type which is detectable by standard techniques in one such state or cell type, but is not detectable in both. Alternatively, the determination is quantitative in that expression is increased or decreased; that is, the expression of the gene is either up-regulated, resulting in an increased amount of transcript, or down-regulated, resulting in a decreased amount of transcript. The degree to which expression differs need only be large enough to quantify via standard characterization techniques as outlined below, such as by use of Affymetrix GeneChip® expression arrays, Lockhart, Nature Biotechnology, 14:1675-1680 (1996), hereby expressly incorporated by reference. Other techniques include, but are not limited to, quantitative reverse transcriptase PCR, Northern analysis and RNase protection. As outlined above, preferably the change in expression (i.e. upregulation or downregulation) is at least about 50%, more preferably at least about 100%, more preferably at least about 150%, more preferably, at least about 200%, with from 300 to at least 1000% being especially preferred.

As will be appreciated by those in the art, this may be done by evaluation at either the gene transcript, or the protein level; that is, the amount of gene expression may be monitored using nucleic acid probes to the DNA or RNA equivalent of the gene transcript, and the quantification of gene expression levels, or, alternatively, the final gene product itself (protein) can be monitored, for example through the use of antibodies to the CA protein and standard immunoassays (ELISAs, etc.) or other techniques, including mass spectroscopy assays, 2D gel electrophoresis assays, etc. Thus, the proteins corresponding to CA genes, i.e. those identified as being important in a particular cancer phenotype, i.e., lymphoma, can be evaluated in a diagnostic test specific for that cancer.

In a preferred embodiment, gene expression monitoring is done and a number of genes, i.e. an expression profile, is monitored simultaneously, although multiple protein expression monitoring can be done as well. Similarly, these assays may be done on an individual basis as well.

In this embodiment, the CA nucleic acid probes may be attached to biochips as outlined herein for the detection and quantification of CA sequences in a particular cell. The assays are done as is known in the art. As will be appreciated by those in the art, any number of different CA sequences may be used as probes, with single sequence assays being used in some cases, and a plurality of the sequences described herein being used in other embodiments. In addition, while solid-phase assays are described, any number of solution based assays may be done as well.

In a preferred embodiment, both solid and solution based assays may be used to detect CA sequences that are up-regulated or down-regulated in cancers as compared to normal tissue. In instances where the CA sequence has been altered but shows the same expression profile or an altered expression profile, the protein will be detected as outlined herein.

In a preferred embodiment nucleic acids encoding the CA protein are detected. Although DNA or RNA encoding the CA protein may be detected, of particular interest are methods wherein the mRNA encoding a CA protein is detected. The presence of mRNA in a sample is an indication that the CA gene has been transcribed to form the mRNA, and suggests that the protein is expressed. Probes to detect the mRNA can be any nucleotide/deoxynucleotide probe that is complementary to and base pairs with the mRNA and includes but is not limited to oligonucleotides, cDNA or RNA. Probes also should contain a detectable label, as defined herein. In one method the mRNA is detected after immobilizing the nucleic acid to be examined on a solid support such as nylon membranes and hybridizing the probe with the sample. Following washing to remove the non-specifically bound probe, the label is detected. In another method detection of the mRNA is performed in situ. In this method permeabilized cells or tissue samples are contacted with a detectably labeled nucleic acid probe for sufficient time to allow the probe to hybridize with the target mRNA. Following washing to remove the non-specifically bound probe, the label is detected. For example a digoxygenin labeled riboprobe (RNA probe) that is complementary to the mRNA encoding a CA protein is detected by binding the digoxygenin with an anti-digoxygenin secondary antibody and developed with nitro blue tetrazolium and 5-bromo-4-chloro-3-indoyl phosphate.

In a preferred embodiment, any of the three classes of proteins as described herein (secreted, transmembrane or intracellular proteins) are used in diagnostic assays. The CA proteins, antibodies, nucleic acids, modified proteins and cells containing CA sequences are used in diagnostic assays. This can be done on an individual gene or corresponding polypeptide level, or as sets of assays.

As described and defined herein, CA proteins find use as markers of cancers, including lymphomas such as, but not limited to, Hodgkin's and non-Hodgkin's lymphoma. Detection of these proteins in putative cancer tissue or patients allows for a determination or diagnosis of the type of cancer. Numerous methods known to those of ordinary skill in the art find use in detecting cancers. In one embodiment, antibodies are used to detect CA proteins. A preferred method separates proteins from a sample or patient by electrophoresis on a gel (typically a denaturing and reducing protein gel, but may be any other type of gel including isoelectric focusing gels and the like). Following separation of proteins, the CA protein is detected by immunoblotting with antibodies raised against the CA protein. Methods of immunoblotting are well known to those of ordinary skill in the art.

In another preferred method, antibodies to the CA protein find use in in situ imaging techniques. In this method cells are contacted with from one to many antibodies to the CA protein(s). Following washing to remove non-specific antibody binding, the presence of the antibody or antibodies is detected. In one embodiment the antibody is detected by incubating with a secondary antibody that contains a detectable label. In another method the primary antibody to the CA protein(s) contains a detectable label. In another preferred embodiment each one of multiple primary antibodies contains a distinct and detectable label. This method finds particular use in simultaneous screening for a plurality of CA proteins. As will be appreciated by one of ordinary skill in the art, numerous other histological imaging techniques are useful in the invention.

In a preferred embodiment the label is detected in a fluorometer that has the ability to detect and distinguish emissions of different wavelengths. In addition, a fluorescence activated cell sorter (FACS) can be used in the method.

In another preferred embodiment, antibodies find use in diagnosing cancers from blood samples. As previously described, certain CA proteins are secreted/circulating molecules. Blood samples, therefore, are useful as samples to be probed or tested for the presence of secreted CA proteins. Antibodies can be used to detect the CA proteins by any of the previously described immunoassay techniques including ELISA, immunoblotting (Western blotting), immunoprecipitation, BIACORE technology and the like, as will be appreciated by one of ordinary skill in the art.

In a preferred embodiment, in situ hybridization of labeled CA nucleic acid probes to tissue arrays is done. For example, arrays of tissue samples, including CA tissue and/or normal tissue, are made. In situ hybridization as is known in the art can then be done.

It is understood that when comparing the expression fingerprints between an individual and a standard, the skilled artisan can make a diagnosis as well as a prognosis. It is further understood that the genes that indicate diagnosis may differ from those that indicate prognosis.

In a preferred embodiment, the CA proteins, antibodies, nucleic acids, modified proteins and cells containing CA sequences are used in prognosis assays. As above, gene expression profiles can be generated that correlate to cancer, especially lymphoma, severity, in terms of long term prognosis. Again, this may be done on either a protein or gene level, with the use of genes being preferred. As above, the CA probes are attached to biochips for the detection and quantification of CA sequences in a tissue or patient. The assays proceed as outlined for diagnosis.

Screening for CA-Targeted Drugs

In one embodiment, any of the CA sequences as described herein are used in drug screening assays. The CA proteins, antibodies, nucleic acids, modified proteins and cells containing CA sequences are used in drug screening assays or by evaluating the effect of drug candidates on a "gene expression profile" or expression profile of polypeptides. In one embodiment, the expression profiles are used, preferably in conjunction with high throughput screening techniques to allow monitoring for expression profile genes after treatment with a candidate agent, Zlokarnik, et al., Science 279, 84-8 (1998), Heid, et al., Genome Res., 6:986-994 (1996).

In another embodiment, the CA proteins, antibodies, nucleic acids, modified proteins and cells containing the native or modified CA proteins are used in screening assays. That is, the present invention provides novel methods for screening for compositions that modulate the cancer phenotype. As above, this can be done by screening for modulators of gene expression or for modulators of protein activity. Similarly, this may be done on an individual gene or protein level or by evaluating the effect of drug candidates on a "gene expression profile". In a preferred embodiment, the expression profiles are used, preferably in conjunction with high throughput screening techniques to allow monitoring for expression profile genes after treatment with a candidate agent, see Zlokarnik, supra.

Having identified the CA genes herein, a variety of assays to evaluate the effects of agents on gene expression may be executed. In a preferred embodiment, assays may be run on an individual gene or protein level. That is, having identified a particular gene as aberrantly regulated in cancer, candidate bioactive agents may be screened to modulate the gene's regulation. "Modulation" thus includes both an increase and a decrease in gene expression or activity. The preferred amount of modulation will depend on the original change of the gene expression in normal versus tumor tissue, with changes of at least 10%, preferably 50%, more preferably 100-300%, and in some embodiments 300-1000% or greater. Thus, if a gene exhibits a 4 fold increase in tumor compared to normal tissue, a decrease of about four fold is desired; a 10 fold decrease in tumor compared to normal tissue gives a 10 fold increase in expression for a candidate agent is desired, etc. Alternatively, where the CA sequence has been altered but shows the same expression profile or an altered expression profile, the protein will be detected as outlined herein.

As will be appreciated by those in the art, this may be done by evaluation at either the gene or the protein level; that is, the amount of gene expression may be monitored using nucleic acid probes and the quantification of gene expression levels, or, alternatively, the level of the gene product itself can be monitored, for example through the use of antibodies to the CA protein and standard immunoassays. Alternatively, binding and bioactivity assays with the protein may be done as outlined below.

In a preferred embodiment, gene expression monitoring is done and a number of genes, i.e. an expression profile, is monitored simultaneously, although multiple protein expression monitoring can be done as well.

In this embodiment, the CA nucleic acid probes are attached to biochips as outlined herein for the detection and quantification of CA sequences in a particular cell. The assays are further described below.

Generally, in a preferred embodiment, a candidate bioactive agent is added to the cells prior to analysis. Moreover, screens are provided to identify a candidate bioactive agent that modulates a particular type of cancer, modulates CA proteins, binds to a CA protein, or interferes between the binding of a CA protein and an antibody.

The term "candidate bioactive agent" or "drug candidate" or grammatical equivalents as used herein describes any molecule, e.g., protein, oligopeptide, small organic or inorganic molecule, polysaccharide, polynucleotide, etc., to be tested for bioactive agents that are capable of directly or indirectly altering either the cancer phenotype, binding to and/or modulating the bioactivity of a CA protein, or the expression of a CA sequence, including both nucleic acid sequences and protein sequences. In a particularly preferred embodiment, the candidate agent suppresses a CA phenotype, for example to a normal tissue fingerprint. Similarly, the candidate agent preferably suppresses a severe CA phenotype. Generally a plurality of assay mixtures are run in parallel with different agent concentrations to obtain a differential response to the various concentrations. Typically, one of these concentrations serves as a negative control, i.e., at zero concentration or below the level of detection.

In one aspect, a candidate agent will neutralize the effect of a CA protein. By "neutralize" is meant that activity of a protein is either inhibited or counter acted against so as to have substantially no effect on a cell.

Candidate agents encompass numerous chemical classes, though typically they are organic or inorganic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof. Particularly preferred are peptides.

Candidate agents are obtained from a wide variety of sources including libraries of synthetic or natural compounds. For example, numerous means are available for random and directed synthesis of a wide variety of organic compounds and biomolecules, including expression of randomized oligonucleotides. Alternatively, libraries of natural compounds in the form of bacterial, fungal, plant and animal extracts are available or readily produced. Additionally, natural or synthetically produced libraries and compounds are readily modified through conventional chemical, physical and biochemical means. Known pharmacological agents may be subjected to directed or random chemical modifications, such as acylation, alkylation, esterification, or amidification to produce structural analogs.

In one embodiment, the candidate bioactive agents are proteins. By "protein" herein is meant at least two covalently attached amino acids, which includes proteins, polypeptides, oligopeptides and peptides. The protein may be made up of naturally occurring amino acids and peptide bonds, or synthetic peptidomimetic structures. Thus "amino acid", or "peptide residue", as used herein means both naturally occurring and synthetic amino acids. For example, homo-phenylalanine, citrulline and norleucine are considered amino acids for the purposes of the invention. "Amino acid" also includes imino acid residues such as proline and hydroxyproline. The side chains may be in either the (R) or the (S) configuration. In the preferred embodiment, the amino acids are in the (S) or L-configuration. If non-naturally occurring side chains are used, non-amino acid substituents may be used, for example to prevent or retard in vivo degradations.

In a preferred embodiment, the candidate bioactive agents are naturally occurring proteins or fragments of naturally occurring proteins. Thus, for example, cellular extracts containing proteins, or random or directed digests of proteinaceous cellular extracts, may be used. In this way libraries of prokaryotic and eukaryotic proteins may be made for screening in the methods of the invention. Particularly preferred in this embodiment are libraries of bacterial, fungal, viral, and mammalian proteins, with the latter being preferred, and human proteins being especially preferred.

In another preferred embodiment, the candidate bioactive agents are peptides of from about 5 to about 30 amino acids, with from about 5 to about 20 amino acids being preferred, and from about 7 to about 15 being particularly preferred. The peptides may be digests of naturally occurring proteins as is outlined above, random peptides, or "biased" random peptides. By "randomized" or grammatical equivalents herein is meant that each nucleic acid and peptide consists of essentially random nucleotides and amino acids, respectively. Since generally these random peptides (or nucleic acids, discussed below) are chemically synthesized, they may incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, the library is fully randomized, with no sequence preferences or constants at any position. In a preferred embodiment, the library is biased. That is, some positions within the sequence are either held constant, or are selected from a limited number of possibilities. For example, in a preferred embodiment, the nucleotides or amino acid residues are randomized within a defined class, for example, of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

In one embodiment, the candidate bioactive agents are nucleic acids. As described generally for proteins, nucleic acid candidate bioactive agents may be naturally occurring nucleic acids, random nucleic acids, or "biased" random nucleic acids. In another embodiment, the candidate bioactive agents are organic chemical moieties, a wide variety of which are available in the literature.

In assays for testing alteration of the expression profile of one or more CA genes, after the candidate agent has been added and the cells allowed to incubate for some period of time, a nucleic acid sample containing the target sequences to be analyzed is prepared. The target sequence is prepared using known techniques (e.g., converted from RNA to labeled cDNA, as described above) and added to a suitable microarray. For example, an in vitro reverse transcription with labels covalently attached to the nucleosides is performed. Generally, the nucleic acids are labeled with a label as defined herein, especially with biotin-FITC or PE, Cy3 and Cy5.

As will be appreciated by those in the art, these assays can be direct hybridization assays or can comprise "sandwich assays", which include the use of multiple probes, as is generally outlined in U.S. Pat. Nos. 5,681,702, 5,597,909, 5,545,730, 5,594,117, 5,591,584, 5,571,670, 5,580,731, 5,571,670, 5,591,584, 5,624,802, 5,635,352, 5,594,118, 5,359,100, 5,124,246 and 5,681,697, all of which are hereby incorporated by reference. In this embodiment, in general, the target nucleic acid is prepared as outlined above, and then added to the biochip comprising a plurality of nucleic acid probes, under conditions that allow the formation of a hybridization complex.

A variety of hybridization conditions may be used in the present invention, including high, moderate and low stringency conditions as outlined above. The assays are generally run under stringency conditions that allow formation of the label probe hybridization complex only in the presence of target. Stringency can be controlled by altering a step parameter that is a thermodynamic variable, including, but not limited to, temperature, formamide concentration, salt concentration, chaotropic salt concentration, pH, organic solvent concentration, etc. These parameters may also be used to control non-specific binding, as is generally outlined in U.S. Pat. No. 5,681,697. Thus it may be desirable to perform certain steps at higher stringency conditions to reduce non-specific binding.

The reactions outlined herein may be accomplished in a variety of ways, as will be appreciated by those in the art. Components of the reaction may be added simultaneously, or sequentially, in any order, with preferred embodiments outlined below. In addition, the reaction may include a variety of other reagents in the assays. These include reagents like salts, buffers, neutral proteins, e.g. albumin, detergents, etc which may be used to facilitate optimal hybridization and detection, and/or reduce non-specific or background interactions. Also reagents that otherwise improve the efficiency of the assay, such as protease inhibitors, nuclease inhibitors, anti-microbial agents, etc., may be used, depending on the sample preparation methods and purity of the target. In addition, either solid phase or solution based (i.e., kinetic PCR) assays may be used.

Once the assay is run, the data are analyzed to determine the expression levels, and changes in expression levels as between states, of individual genes, forming a gene expression profile.

In a preferred embodiment, as for the diagnosis and prognosis applications, having identified the differentially expressed gene(s) or mutated gene(s) important in any one state, screens can be run to test for alteration of the expression of the CA genes individually. That is, screening for modulation of regulation of expression of a single gene can be done. Thus, for example, in the case of target genes whose presence or absence is unique between two states, screening is done for modulators of the target gene expression.

In addition, screens can be done for novel genes that are induced in response to a candidate agent. After identifying a candidate agent based upon its ability to suppress a CA expression pattern leading to a normal expression pattern, or modulate a single CA gene expression profile so as to mimic the expression of the gene from normal tissue, a screen as described above can be performed to identify genes that are specifically modulated in response to the agent. Comparing expression profiles between normal tissue and agent treated CA tissue reveals genes that are not expressed in normal tissue or CA tissue, but are expressed in agent treated tissue. These agent specific sequences can be identified and used by any of the methods described herein for CA genes or proteins. In particular these sequences and the proteins they encode find use in marking or identifying agent-treated cells. In addition, antibodies can be raised against the agent-induced proteins and used to target novel therapeutics to the treated CA tissue sample.

Thus, in one embodiment, a candidate agent is administered to a population of CA cells, that thus has an associated CA expression profile. By "administration" or "contacting" herein is meant that the candidate agent is added to the cells in such a manner as to allow the agent to act upon the cell, whether by uptake and intracellular action, or by action at the cell surface. In some embodiments, nucleic acid encoding a proteinaceous candidate agent (i.e. a peptide) may be put into a viral construct such as a retroviral construct and added to the cell, such that expression of the peptide agent is accomplished; see PCT US97/01019, hereby expressly incorporated by reference.

Once the candidate agent has been administered to the cells, the cells can be washed if desired and are allowed to incubate under preferably physiological conditions for some period of time. The cells are then harvested and a new gene expression profile is generated, as outlined herein.

Thus, for example, CA tissue may be screened for agents that reduce or suppress the CA phenotype. A change in at least one gene of the expression profile indicates that the agent has an effect on CA activity. By defining such a signature for the CA phenotype, screens for new drugs that alter the phenotype can be devised. With this approach, the drug target need not be known and need not be represented in the original expression screening platform, nor does the level of transcript for the target protein need to change.

In a preferred embodiment, as outlined above, screens may be done on individual genes and gene products (proteins). That is, having identified a particular differentially expressed gene as important in a particular state, screening of modulators of either the expression of the gene or the gene product itself can be done. The gene products of differentially expressed genes are sometimes referred to herein as "CA proteins" or "CAP". The CAP may be a fragment, or alternatively, be the full-length protein to the fragment encoded by the nucleic acids of Tables 1-27 (human genomic sequences of SEQ ID NOS: 4, 10, 16, 26, 32, 38, 50, 56, 66, 74, 77, 83, 93, 99, 105, 111, 117, 125, 133, 139, 145, 151, 163, 169, 179, 189, 195, and 201, and sequences of SEQ ID NOS: 5, 11, 17, 19, 21, 27, 33, 39, 51, 57, 59, 61, 67, 69, 75, 78, 84, 86, 88, 94, 100, 106, 112, 118, 120, 126, 134, 140, 146, 152, 154, 156, 158, 164, 170, 172, 174, 180, 182, 184, 190, 196, and 202 corresponding to the human mRNAs generated therefrom). In a preferred embodiment, the CAP is selected from the human protein sequences shown in Tables 1-27 (of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203). In another embodiment, the sequences are sequence variants as further described herein.

Preferably, the CAP is a fragment approximately 14 to 24 amino acids in length. More preferably the fragment is a soluble fragment. Preferably, the fragment includes a non-transmembrane region. In a preferred embodiment, the fragment has an N-terminal Cys to aid in solubility. In one embodiment, the C-terminus of the fragment is kept as a free acid and the N-terminus is a free amine to aid in coupling, e.g., to a cysteine.

In one embodiment the CA proteins are conjugated to an immunogenic agent as discussed herein. In one embodiment the CA protein is conjugated to BSA.

In a preferred embodiment, screening is done to alter the biological function of the expression product of the CA gene. Again, having identified the importance of a gene in a particular state, screening for agents that bind and/or modulate the biological activity of the gene product can be run as is more fully outlined below.

In a preferred embodiment, screens are designed to first find candidate agents that can bind to CA proteins, and then these agents may be used in assays that evaluate the ability of the candidate agent to modulate the CAP activity and the cancer phenotype. Thus, as will be appreciated by those in the art, there are a number of different assays that may be run; binding assays and activity assays.

In a preferred embodiment, binding assays are done. In general, purified or isolated gene product is used; that is, the gene products of one or more CA nucleic acids are made. In general, this is done as is known in the art. For example, antibodies are generated to the protein gene products, and standard immunoassays are run to determine the amount of protein present. Alternatively, cells comprising the CA proteins can be used in the assays.

Thus, in a preferred embodiment, the methods comprise combining a CA protein and a candidate bioactive agent, and determining the binding of the candidate agent to the CA protein. Preferred embodiments utilize the human or mouse CA protein, although other mammalian proteins may also be used, for example for the development of animal models of human disease. In some embodiments, as outlined herein, variant or derivative CA proteins may be used.

Generally, in a preferred embodiment of the methods herein, the CA protein or the candidate agent is non-diffusably bound to an insoluble support having isolated sample receiving areas (e.g. a microtiter plate, an array, etc.). The insoluble support may be made of any composition to which the compositions can be bound, is readily separated from soluble material, and is otherwise compatible with the overall method of screening. The surface of such supports may be solid or porous and of any convenient shape. Examples of suitable insoluble supports include microtiter plates, arrays, membranes and beads. These are typically made of glass, plastic (e.g., polystyrene), polysaccharides, nylon or nitrocellulose, Teflon®, etc. Microtiter plates and arrays are especially convenient because a large number of assays can be carried out simultaneously, using small amounts of reagents and samples.

The particular manner of binding of the composition is not crucial so long as it is compatible with the reagents and overall methods of the invention, maintains the activity of the composition and is nondiffusable. Preferred methods of binding include the use of antibodies (which do not sterically block either the ligand binding site or activation sequence when the protein is bound to the support), direct binding to "sticky" or ionic supports, chemical crosslinking, the synthesis of the protein or agent on the surface, etc. Following binding of the protein or agent, excess unbound material is removed by washing. The sample receiving areas may then be blocked through incubation with bovine serum albumin (BSA), casein or other innocuous protein or other moiety.

In a preferred embodiment, the CA protein is bound to the support, and a candidate bioactive agent is added to the assay. Alternatively, the candidate agent is bound to the support and the CA protein is added. Novel binding agents include specific antibodies, non-natural binding agents identified in screens of chemical libraries, peptide analogs, etc. Of particular interest are screening assays for agents that have a low toxicity for human cells. A wide variety of assays may be used for this purpose, including labeled in vitro protein-protein binding assays, electrophoretic mobility shift assays, immunoassays for protein binding, functional assays (phosphorylation assays, etc.) and the like.

The determination of the binding of the candidate bioactive agent to the CA protein may be done in a number of ways. In a preferred embodiment, the candidate bioactive agent is labeled, and binding determined directly. For example, this may be done by attaching all or a portion of the CA protein to a solid support, adding a labeled candidate agent (for example a fluorescent label), washing off excess reagent, and determining whether the label is present on the solid support. Various blocking and washing steps may be utilized as is known in the art.

By "labeled" herein is meant that the compound is either directly or indirectly labeled with a label which provides a detectable signal, e.g. radioisotope, fluorescers, enzyme, antibodies, particles such as magnetic particles, chemiluminescers, or specific binding molecules, etc. Specific binding molecules include pairs, such as biotin and streptavidin, digoxin and antidigoxin etc. For the specific binding members, the complementary member would normally be labeled with a molecule which provides for detection, in accordance with known procedures, as outlined above. The label can directly or indirectly provide a detectable signal.

In some embodiments, only one of the components is labeled. For example, the proteins (or proteinaceous candidate agents) may be labeled at tyrosine positions using $^{125}$I, or with fluorophores. Alternatively, more than one component may be labeled with different labels; using $^{125}$I for the proteins, for example, and a fluorophore for the candidate agents.

In a preferred embodiment, the binding of the candidate bioactive agent is determined through the use of competitive binding assays. In this embodiment, the competitor is a binding moiety known to bind to the target molecule (i.e. CA protein), such as an antibody, peptide, binding partner, ligand, etc. Under certain circumstances, there may be competitive binding as between the bioactive agent and the binding moiety, with the binding moiety displacing the bioactive agent.

In one embodiment, the candidate bioactive agent is labeled. Either the candidate bioactive agent, or the competitor, or both, is added first to the protein for a time sufficient to allow binding, if present. Incubations may be performed at any temperature which facilitates optimal activity, typically between 4 and 40° C. Incubation periods are selected for optimum activity, but may also be optimized to facilitate rapid high throughput screening. Typically between 0.1 and 1 hour will be sufficient. Excess reagent is generally removed or washed away. The second component is then added, and the presence or absence of the labeled component is followed, to indicate binding.

In a preferred embodiment, the competitor is added first, followed by the candidate bioactive agent. Displacement of the competitor is an indication that the candidate bioactive agent is binding to the CA protein and thus is capable of binding to, and potentially modulating, the activity of the CA protein. In this embodiment, either component can be labeled. Thus, for example, if the competitor is labeled, the presence of label in the wash solution indicates displacement by the agent. Alternatively, if the candidate bioactive agent is labeled, the presence of the label on the support indicates displacement.

In an alternative embodiment, the candidate bioactive agent is added first, with incubation and washing, followed by the competitor. The absence of binding by the competitor may indicate that the bioactive agent is bound to the CA protein with a higher affinity. Thus, if the candidate bioactive agent is labeled, the presence of the label on the support, coupled with a lack of competitor binding, may indicate that the candidate agent is capable of binding to the CA protein.

In a preferred embodiment, the methods comprise differential screening to identity bioactive agents that are capable of modulating the activity of the CA proteins. In this embodiment, the methods comprise combining a CA protein and a competitor in a first sample. A second sample comprises a candidate bioactive agent, a CA protein and a competitor. The binding of the competitor is determined for both samples, and a change, or difference in binding between the two samples indicates the presence of an agent capable of binding to the CA protein and potentially modulating its activity. That is, if the binding of the competitor is different in the second sample relative to the first sample, the agent is capable of binding to the CA protein.

Alternatively, a preferred embodiment utilizes differential screening to identify drug candidates that bind to the native CA protein, but cannot bind to modified CA proteins. The structure of the CA protein may be modeled, and used in rational drug design to synthesize agents that interact with that site. Drug candidates that affect CA bioactivity are also identified by screening drugs for the ability to either enhance or reduce the activity of the protein.

Positive controls and negative controls may be used in the assays. Preferably all control and test samples are performed in at least triplicate to obtain statistically significant results. Incubation of all samples is for a time sufficient for the binding of the agent to the protein. Following incubation, all samples are washed free of non-specifically bound material and the amount of bound, generally labeled agent determined. For example, where a radiolabel is employed, the samples may be counted in a scintillation counter to determine the amount of bound compound.

A variety of other reagents may be included in the screening assays. These include reagents like salts, neutral proteins, e.g. albumin, detergents, etc which may be used to facilitate optimal protein-protein binding and/or reduce non-specific or background interactions. Also reagents that otherwise improve the efficiency of the assay, such as protease inhibitors, nuclease inhibitors, anti-microbial agents, etc., may be used. The mixture of components may be added in any order that provides for the requisite binding.

Screening for agents that modulate the activity of CA proteins may also be done. In a preferred embodiment, methods for screening for a bioactive agent capable of modulating the activity of CA proteins comprise the steps of adding a candidate bioactive agent to a sample of CA proteins, as above, and determining an alteration in the biological activity of CA proteins. "Modulating the activity of a CA protein" includes an increase in activity, a decrease in activity, or a change in the type or kind of activity present. Thus, in this embodiment, the candidate agent should both bind to CA proteins (although this may not be necessary), and alter its biological or biochemical activity as defined herein. The methods include both in vitro screening methods, as are generally outlined above, and in vivo screening of cells for alterations in the presence, distribution, activity or amount of CA proteins.

Thus, in this embodiment, the methods comprise combining a CA sample and a candidate bioactive agent, and evaluating the effect on CA activity. By "CA activity" or grammatical equivalents herein is meant one of the CA protein's biological activities, including, but not limited to, its role in tumorigenesis, including cell division, preferably in lymphatic tissue, cell proliferation, tumor growth and transformation of cells. In one embodiment, CA activity includes activation of or by a protein encoded by a nucleic acid of Tables 1-27. An inhibitor of CA activity is the inhibition of any one or more CA activities.

In a preferred embodiment, the activity of the CA protein is increased; in another preferred embodiment, the activity of the CA protein is decreased. Thus, bioactive agents that are antagonists are preferred in some embodiments, and bioactive agents that are agonists may be preferred in other embodiments.

In a preferred embodiment, the invention provides methods for screening for bioactive agents capable of modulating the activity of a CA protein. The methods comprise adding a candidate bioactive agent, as defined above, to a cell comprising CA proteins. Preferred cell types include almost any cell. The cells contain a recombinant nucleic acid that encodes a CA protein. In a preferred embodiment, a library of candidate agents is tested on a plurality of cells.

In one aspect, the assays are evaluated in the presence or absence or previous or subsequent exposure of physiological signals, for example hormones, antibodies, peptides, antigens, cytokines, growth factors, action potentials, pharmacological agents including chemotherapeutics, radiation, carcinogenics, or other cells (i.e. cell-cell contacts). In another example, the determinations are determined at different stages of the cell cycle process.

In this way, bioactive agents are identified. Compounds with pharmacological activity are able to enhance or interfere with the activity of the CA protein.

Applications of the Invention

In one embodiment, a method of inhibiting cancer cell division is provided. In another embodiment, a method of inhibiting tumor growth is provided. In a further embodiment, methods of treating cells or individuals with cancer are provided.

The method comprises administration of a cancer inhibitor. In particular embodiments, the cancer inhibitor is an antisense molecule, a pharmaceutical composition, a therapeutic agent or small molecule, or a monoclonal, polyclonal, chimeric or humanized antibody. In particular embodiments, a therapeutic agent is coupled with a an antibody, preferable a monoclonal antobody.

In other embodiments, methods for detection or diagnosis of cancer cells in an individual are provided. In particular embodiments, the diagnostic/detection agent is a small molecule that pereferentially binds to a CAP according to the invention. In one embodiment, the diagnostic/detection agent is an antibody, preferably a monoclonal antobody, preferably linked to a detectable agent.

In other embodiments of the invention, animal models and transgenic animals are provided, which find use in generating animal models of cancers, particularly lymphomas and carcinomas.

(a) Antisense Molecules

In one embodiment, the cancer inhibitor is an antisense molecule. Antisense molecules as used herein include antisense or sense oligonucleotides comprising a single-stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 14 nucleotides, preferably from about 14 to 30 nucleotides. The ability to derive an antisense or a sense oligonucleotide, based upon a cDNA sequence encoding a given protein is described in, for example, Stein and Cohen, Cancer Res. 48:2659, (1988) and van der Krol et al., BioTechniques 6:958, (1988).

Antisense molecules may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a sense or an antisense oligonucleotide may be introduced into a cell containing the target nucleic acid sequence by formation of an oligonucleotide-lipid complex, as described in WO 90/10448. It is understood that the use of antisense molecules or knock out and knock in models may also be used in screening assays as discussed above, in addition to methods of treatment.

(b) Pharmaceutical Compositions

Pharmaceutical compositions encompassed by the present invention include as active agent, the polypeptides, polynucleotides, antisense oligonucleotides, or antibodies of the invention disclosed herein in a therapeutically effective amount. An "effective amount" is an amount sufficient to effect beneficial or desired results, including clinical results. An effective amount can be administered in one or more administrations. For purposes of this invention, an effective amount of an adenoviral vector is an amount that is sufficient to palliate, ameliorate, stabilize, reverse, slow or delay the progression of the disease state.

The compositions can be used to treat cancer as well as metastases of primary cancer. In addition, the pharmaceutical compositions can be used in conjunction with conventional methods of cancer treatment, e.g., to sensitize tumors to radiation or conventional chemotherapy. The terms "treatment", "treating", "treat" and the like are used herein to generally refer to obtaining a desired pharmacologic and/or physiologic effect. The effect may be prophylactic in terms of completely or partially preventing a disease or symptom thereof and/or may be therapeutic in terms of a partial or complete stabilization or cure for a disease and/or adverse effect attributable to the disease. "Treatment" as used herein covers any treatment of a disease in a mammal, particularly a human, and includes: (a) preventing the disease or symptom from occurring in a subject which may be predisposed to the disease or symptom but has not yet been diagnosed as having it; (b) inhibiting the disease symptom, i.e., arresting its development; or (c) relieving the disease symptom, i.e., causing regression of the disease or symptom.

Where the pharmaceutical composition comprises an antibody that specifically binds to a gene product encoded by a differentially expressed polynucleotide, the antibody can be coupled to a drug for delivery to a treatment site or coupled to a detectable label to facilitate imaging of a site comprising cancer cells, such as prostate cancer cells. Methods for coupling antibodies to drugs and detectable labels are well known in the art, as are methods for imaging using detectable labels.

A "patient" for the purposes of the present invention includes both humans and other animals, particularly mammals, and organisms. Thus the methods are applicable to both human therapy and veterinary applications. In the preferred embodiment the patient is a mammal, and in the most preferred embodiment the patient is human.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. The effective amount for a given situation is determined by routine experimentation and is within the judgment of the clinician. For purposes of the present invention, an effective dose will generally be from about 0.01 mg/kg to about 5 mg/kg, or about 0.01 mg/kg to about 50 mg/kg or about 0.05 mg/kg to about 10 mg/kg of the compositions of the present invention in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which can be administered without undue toxicity. Suitable carriers can be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art. Pharmaceutically acceptable carriers in therapeutic compositions can include liquids such as water, saline, glycerol and ethanol. Auxiliary substances, such as wetting or emulsifying agents, pH buffering substances, and the like, can also be present in such vehicles. Typically, the therapeutic compositions are prepared as injectables, either as liquid solutions or suspensions; solid forms suitable for solution in, or suspension in, liquid vehicles prior to injection can also be prepared. Liposomes are included within the definition of a pharmaceutically acceptable carrier. Pharmaceutically acceptable salts can also be present in the pharmaceutical composition, e.g., mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in *Remington: The Science and Practice of Pharmacy* (1995) Alfonso Gennaro, Lippincott, Williams, & Wilkins.

The pharmaceutical compositions can be prepared in various forms, such as granules, tablets, pills, suppositories, capsules, suspensions, salves, lotions and the like. Pharmaceutical grade organic or inorganic carriers and/or diluents suitable for oral and topical use can be used to make up compositions containing the therapeutically-active compounds. Diluents known to the art include aqueous media, vegetable and animal oils and fats. Stabilizing agents, wetting and emulsifying agents, salts for varying the osmotic pressure or buffers for securing an adequate pH value, and skin penetration enhancers can be used as auxiliary agents.

The pharmaceutical compositions of the present invention comprise a CA protein in a form suitable for administration to a patient. In the preferred embodiment, the pharmaceutical compositions are in a water soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non-toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine.

The pharmaceutical compositions may also include one or more of the following: carrier proteins such as serum albumin; buffers; fillers such as microcrystalline cellulose, lactose, corn and other starches; binding agents; sweeteners and other flavoring agents; coloring agents; and polyethylene glycol. Additives are well known in the art, and are used in a variety of formulations.

The compounds having the desired pharmacological activity may be administered in a physiologically acceptable carrier to a host, as previously described. The agents may be administered in a variety of ways, orally, parenterally e.g., subcutaneously, intraperitoneally, intravascularly, etc. Depending upon the manner of introduction, the compounds may be formulated in a variety of ways. The concentration of therapeutically active compound in the formulation may vary from about 0.1-100% wgt/vol. Once formulated, the compositions contemplated by the invention can be (1) administered directly to the subject (e.g., as polynucleotide, polypeptides, small molecule agonists or antagonists, and the like); or (2) delivered ex vivo, to cells derived from the subject (e.g., as in ex vivo gene therapy). Direct delivery of the compositions will generally be accomplished by parenteral injection, e.g., subcutaneously, intraperitoneally, intravenously or intramuscularly, intratumoral or to the interstitial space of a tissue. Other modes of administration include oral and pulmonary administration, suppositories, and transdermal applications, needles, and gene guns or hyposprays. Dosage treatment can be a single dose schedule or a multiple dose schedule.

Methods for the ex vivo delivery and reimplantation of transformed cells into a subject are known in the art and described in e.g., International Publication No. WO 93/14778. Examples of cells useful in ex vivo applications include, for example, stem cells, particularly hematopoetic, lymph cells, macrophages, dendritic cells, or tumor cells. Generally, delivery of nucleic acids for both ex vivo and in vitro applications can be accomplished by, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Once differential expression of a gene corresponding to a CA polynucleotide described herein has been found to correlate with a proliferative disorder, such as neoplasia, dysplasia, and hyperplasia, the disorder can be amenable to treatment by administration of a therapeutic agent based on the provided polynucleotide, corresponding polypeptide or other corresponding molecule (e.g., antisense, ribozyme, etc.). In other embodiments, the disorder can be amenable to treatment by administration of a small molecule drug that, for example, serves as an inhibitor (antagonist) of the function of the encoded gene product of a gene having increased expression in cancerous cells relative to normal cells or as an agonist for gene products that are decreased in expression in cancerous cells (e.g., to promote the activity of gene products that act as tumor suppressors).

The dose and the means of administration of the inventive pharmaceutical compositions are determined based on the specific qualities of the therapeutic composition, the condition, age, and weight of the patient, the progression of the disease, and other relevant factors. For example, administration of polynucleotide therapeutic compositions agents includes local or systemic administration, including injection, oral administration, particle gun or catheterized administration, and topical administration. Preferably, the therapeutic polynucleotide composition contains an expression construct comprising a promoter operably linked to a polynucleotide of at least 12, 22, 25, 30, or 35 contiguous nt of the polynucleotide disclosed herein. Various methods can be used to administer the therapeutic composition directly to a specific site in the body. For example, a small metastatic lesion is located and the therapeutic composition injected several times in several different locations within the body of tumor. Alternatively, arteries that serve a tumor are identified, and the therapeutic composition injected into such an artery, in order to deliver the composition directly into the tumor. A tumor that has a necrotic center is aspirated and the composition injected directly into the now empty center of the tumor. An antisense composition is directly administered to the surface of the tumor, for example, by topical application of the composition. X-ray imaging is used to assist in certain of the above delivery methods.

Targeted delivery of therapeutic compositions containing an antisense polynucleotide, subgenomic polynucleotides, or antibodies to specific tissues can also be used. Receptor-mediated DNA delivery techniques are described in, for example, Findeis et al., *Trends Biotechnol.* (1993) 11:202; Chiou et al., *Gene Therapeutics: Methods And Applications Of Direct Gene Transfer* (J. A. Wolff, ed.) (1994); Wu et al., *J. Biol. Chem.* (1988) 263:621; Wu et al., *J. Biol. Chem.* (1994) 269:542; Zenke et al., *Proc. Natl. Acad. Sci. (USA)* (1990) 87:3655; Wu et al., *J. Biol. Chem.* (1991) 266:338. Therapeutic compositions containing a polynucleotide are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g., for enhancing or inhibiting levels of the encoded gene product) and efficacy of transformation and expression are considerations that will affect the dosage required for ultimate efficacy of the antisense subgenomic polynucleotides. Where greater expression is desired over a larger area of tissue, larger amounts of antisense subgenomic polynucleotides or the same amounts re-administered in a successive protocol of administrations, or several administrations to different adjacent or close tissue portions of, for example, a tumor site, may be required to effect a positive therapeutic outcome. In all cases, routine experimentation in clinical trials will determine specific ranges for optimal therapeutic effect.

The therapeutic polynucleotides and polypeptides of the present invention can be delivered using gene delivery vehicles. The gene delivery vehicle can be of viral or non-viral origin (see generally, Jolly, *Cancer Gene Therapy* (1994) 1:51; Kimura, *Human Gene Therapy* (1994) 5:845; Connelly, *Human Gene Therapy* (1995) 1:185; and Kaplitt, *Nature Genetics* (1994) 6:148). Expression of such coding sequences can be induced using endogenous mammalian or heterologous promoters. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., WO 90/07936; WO 94/03622; WO 93/25698; WO 93/25234; U.S. Pat. No. 5,219,740; WO 93/11230; WO 93/10218; U.S. Pat. No. 4,777,127; GB Patent No. 2,200,651; EP 0 345 242; and WO 91/02805), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., WO 94/12649, WO 93/03769; WO 93/19191; WO 94/28938; WO 95/11984 and WO 95/00655). Administration of DNA linked to killed adenovirus as described in Curiel, *Hum. Gene Ther.* (1992) 3:147 can also be employed.

Non-viral delivery vehicles and methods can also be employed, including, but not limited to, polycationic condensed DNA linked or unlinked to killed adenovirus alone (see, e.g., Curiel, *Hum. Gene Ther.* (1992) 3:147); ligand-linked DNA (see, e.g., Wu, *J. Biol. Chem.* (1989) 264:16985); eukaryotic cell delivery vehicles cells (see, e.g., U.S. Pat. No. 5,814,482; WO 95/07994; WO 96/17072; WO 95/30763; and WO 97/42338) and nucleic charge neutralization or fusion with cell membranes. Naked DNA can also be employed. Exemplary naked DNA introduction methods are described in WO 90/11092 and U.S. Pat. No. 5,580,859. Liposomes that can act as gene delivery vehicles are described in U.S. Pat. No. 5,422,120; WO 95/13796; WO 94/23697; WO 91/14445; and EP 0524968. Additional approaches are described in Philip, *Mol. Cell Biol.* (1994) 14:2411, and in Woffendin, *Proc. Natl. Acad. Sci.* (1994) 91:1581.

Further non-viral delivery suitable for use includes mechanical delivery systems such as the approach described in Woffendin et al., *Proc. Natl. Acad. Sci. USA* (1994) 91(24): 11581. Moreover, the coding sequence and the product of expression of such can be delivered through deposition of photopolymerized hydrogel materials or use of ionizing radiation (see, e.g., U.S. Pat. No. 5,206,152 and WO 92/11033). Other conventional methods for gene delivery that can be used for delivery of the coding sequence include, for example, use of hand-held gene transfer particle gun (see, e.g., U.S. Pat. No. 5,149,655); use of ionizing radiation for activating transferred gene (see, e.g., U.S. Pat. No. 5,206,152 and WO 92/11033).

The administration of the CA proteins and modulators of the present invention can be done in a variety of ways as discussed above, including, but not limited to, orally, subcutaneously, intravenously, intranasally, transdermally, intraperitoneally, intramuscularly, intrapulmonary, vaginally, rectally, or intraocularly. In some instances, for example, in the treatment of wounds and inflammation, the CA proteins and modulators may be directly applied as a solution or spray.

In a preferred embodiment, CA proteins and modulators are administered as therapeutic agents, and can be formulated as outlined above. Similarly, CA genes (including both the full-length sequence, partial sequences, or regulatory sequences of the CA coding regions) can be administered in gene therapy applications, as is known in the art. These CA genes can include antisense applications, either as gene therapy (i.e. for incorporation into the genome) or as antisense compositions, as will be appreciated by those in the art.

Thus, in one embodiment, methods of modulating CA gene activity in cells or organisms are provided. In one embodiment, the methods comprise administering to a cell an anti-CA antibody that reduces or eliminates the biological activity of an endogenous CA protein. Alternatively, the methods comprise administering to a cell or organism a recombinant nucleic acid encoding a CA protein. As will be appreciated by those in the art, this may be accomplished in any number of ways. In a preferred embodiment, for example when the CA sequence is down-regulated in cancer, the activity of the CA gene product is increased by increasing the amount of CA expression in the cell, for example by overexpressing the endogenous CA gene or by administering a gene encoding the CA sequence, using known gene-therapy techniques. In a preferred embodiment, the gene therapy techniques include the incorporation of the exogenous gene using enhanced homologous recombination (EHR), for example as described in PCT/US93/03868, hereby incorporated by reference in its entirety. Alternatively, for example when the CA sequence is up-regulated in cancer, the activity of the endogenous CA gene is decreased, for example by the administration of a CA antisense nucleic acid.

(c) Vaccines

In a preferred embodiment, CA genes are administered as DNA vaccines, either single genes or combinations of CA genes. Naked DNA vaccines are generally known in the art. Brower, Nature Biotechnology, 16:1304-1305 (1998).

In one embodiment, CA genes of the present invention are used as DNA vaccines. Methods for the use of genes as DNA vaccines are well known to one of ordinary skill in the art, and include placing a CA gene or portion of a CA gene under the control of a promoter for expression in a patient with cancer. The CA gene used for DNA vaccines can encode full-length CA proteins, but more preferably encodes portions of the CA proteins including peptides derived from the CA protein. In a preferred embodiment a patient is immunized with a DNA vaccine comprising a plurality of nucleotide sequences derived from a CA gene. Similarly, it is possible to immunize a patient with a plurality of CA genes or portions thereof. Without being bound by theory, expression of the polypeptide encoded by the DNA vaccine, cytotoxic T-cells, helper T-cells and antibodies are induced that recognize and destroy or eliminate cells expressing CA proteins.

In a preferred embodiment, the DNA vaccines include a gene encoding an adjuvant molecule with the DNA vaccine. Such adjuvant molecules include cytokines that increase the immunogenic response to the CA polypeptide encoded by the DNA vaccine. Additional or alternative adjuvants are known to those of ordinary skill in the art and find use in the invention.

(d) Antibodies

In one embodiment, a cancer inhibitor is an antibody as discussed above. In one embodiment, the CA proteins of the present invention may be used to generate polyclonal and monoclonal antibodies to CA proteins, which are useful as described herein. Similarly, the CA proteins can be coupled, using standard technology, to affinity chromatography columns. These columns may then be used to purify CA antibodies. In a preferred embodiment, the antibodies are generated to epitopes unique to a CA protein; that is, the antibodies show little or no cross-reactivity to other proteins. These antibodies find use in a number of applications. For example, the CA antibodies may be coupled to standard affinity chromatography columns and used to purify CA proteins. The antibodies may also be used therapeutically as blocking polypeptides, as outlined above, since they will specifically bind to the CA protein.

The present invention further provides methods for detecting the presence of and/or measuring a level of a polypeptide in a biological sample, which CA polypeptide is encoded by a CA polynucleotide that is differentially expressed in a cancer cell, using an antibody specific for the encoded polypeptide. The methods generally comprise: a) contacting the sample with an antibody specific for a polypeptide encoded by a CA polynucleotide that is differentially expressed in a prostate cancer cell; and b) detecting binding between the antibody and molecules of the sample.

Detection of specific binding of the antibody specific for the encoded cancer-associated polypeptide, when compared to a suitable control is an indication that encoded polypeptide is present in the sample. Suitable controls include a sample known not to contain the encoded CA polypeptide or known not to contain elevated levels of the polypeptide; such as normal tissue, and a sample contacted with an antibody not specific for the encoded polypeptide, e.g., an anti-idiotype antibody. A variety of methods to detect specific antibody-antigen interactions are known in the art and can be used in the method, including, but not limited to, standard immunohistological methods, immunoprecipitation, an enzyme immunoassay, and a radioimmunoassay. In general, the specific antibody will be detectably labeled, either directly or indirectly. Direct labels include radioisotopes; enzymes whose products are detectable (e.g., luciferase, β-galactosidase, and the like); fluorescent labels (e.g., fluorescein isothiocyanate, rhodamine, phycoerythrin, and the like); fluorescence emitting metals, e.g., $^{152}$Eu, or others of the lanthanide series, attached to the antibody through metal chelating groups such as EDTA; chemiluminescent compounds, e.g., luminol, isoluminol, acridinium salts, and the like; bioluminescent compounds, e.g., luciferin, aequorin (green fluorescent protein), and the like. The antibody may be attached (coupled) to an insoluble support, such as a polystyrene plate or a bead. Indirect labels include second antibodies specific for antibodies specific for the encoded polypeptide ("first specific antibody"), wherein the second antibody is labeled as described above; and members of specific binding pairs, e.g., biotin-avidin, and the like. The biological sample may be brought into contact with and immobilized on a solid support or carrier, such as nitrocellulose, that is capable of immobilizing cells, cell particles, or soluble proteins. The support may then be washed with suitable buffers, followed by contacting with a detectably-labeled first specific antibody. Detection methods are known in the art and will be chosen as appropriate to the signal emitted by the detectable label. Detection is generally accomplished in comparison to suitable controls, and to appropriate standards.

In some embodiments, the methods are adapted for use in vivo, e.g., to locate or identify sites where cancer cells are present. In these embodiments, a detectably-labeled moiety, e.g., an antibody, which is specific for a cancer-associated polypeptide is administered to an individual (e.g., by injection), and labeled cells are located using standard imaging techniques, including, but not limited to, magnetic resonance imaging, computed tomography scanning, and the like. In this manner, cancer cells are differentially labeled.

(e) Detection and Diagnosis of Cancers

Without being bound by theory, it appears that the various CA sequences are important in cancers. Accordingly, disorders based on mutant or variant CA genes may be determined. In one embodiment, the invention provides methods for identifying cells containing variant CA genes comprising determining all or part of the sequence of at least one endogenous CA genes in a cell. As will be appreciated by those in the art, this may be done using any number of sequencing techniques. In a preferred embodiment, the invention provides methods of identifying the CA genotype of an individual comprising determining all or part of the sequence of at least one CA gene of the individual. This is generally done in at least one tissue of the individual, and may include the evaluation of a number of tissues or different samples of the same tissue. The method may include comparing the sequence of the sequenced CA gene to a known CA gene, i.e., a wild-type gene. As will be appreciated by those in the art, alterations in the sequence of some CA genes can be an indication of either the presence of the disease, or propensity to develop the disease, or prognosis evaluations.

The sequence of all or part of the CA gene can then be compared to the sequence of a known CA gene to determine if any differences exist. This can be done using any number of known homology programs, such as Bestfit, etc. In a preferred embodiment, the presence of a difference in the sequence between the CA gene of the patient and the known CA gene is indicative of a disease state or a propensity for a disease state, as outlined herein.

In a preferred embodiment, the CA genes are used as probes to determine the number of copies of the CA gene in the genome. For example, some cancers exhibit chromosomal deletions or insertions, resulting in an alteration in the copy number of a gene.

In another preferred embodiment CA genes are used as probes to determine the chromosomal location of the CA genes. Information such as chromosomal location finds use in providing a diagnosis or prognosis in particular when chromosomal abnormalities such as translocations, and the like are identified in CA gene loci.

The present invention provides methods of using the polynucleotides described herein for detecting cancer cells, facilitating diagnosis of cancer and the severity of a cancer (e.g., tumor grade, tumor burden, and the like) in a subject, facilitating a determination of the prognosis of a subject, and assessing the responsiveness of the subject to therapy (e.g., by providing a measure of therapeutic effect through, for example, assessing tumor burden during or following a chemotherapeutic regimen). Detection can be based on detection of a polynucleotide that is differentially expressed in a cancer cell, and/or detection of a polypeptide encoded by a polynucleotide that is differentially expressed in a cancer cell. The detection methods of the invention can be conducted in vitro or in vivo, on isolated cells, or in whole tissues or a bodily fluid e.g., blood, plasma, serum, urine, and the like).

In some embodiments, methods are provided for detecting a cancer cell by detecting expression in the cell of a transcript that is differentially expressed in a cancer cell. Any of a variety of known methods can be used for detection, including, but not limited to, detection of a transcript by hybridization with a polynucleotide that hybridizes to a polynucleotide that is differentially expressed in a prostate cancer cell; detection of a transcript by a polymerase chain reaction using specific oligonucleotide primers; in situ hybridization of a cell using as a probe a polynucleotide that hybridizes to a gene that is differentially expressed in a prostate cancer cell. The methods can be used to detect and/or measure mRNA levels of a gene that is differentially expressed in a cancer cell. In some embodiments, the methods comprise: a) contacting a sample with a polynucleotide that corresponds to a differentially expressed gene described herein under conditions that allow hybridization; and b) detecting hybridization, if any.

Detection of differential hybridization, when compared to a suitable control, is an indication of the presence in the sample of a polynucleotide that is differentially expressed in a cancer cell. Appropriate controls include, for example, a sample that is known not to contain a polynucleotide that is differentially expressed in a cancer cell, and use of a labeled polynucleotide of the same "sense" as the polynucleotide that is differentially expressed in the cancer cell. Conditions that allow hybridization are known in the art, and have been described in more detail above. Detection can also be accomplished by any known method, including, but not limited to, in situ hybridization, PCR (polymerase chain reaction), RT-PCR (reverse transcription-PCR), TMA, bDNA, and Nasbau and "Northern" or RNA blotting, or combinations of such techniques, using a suitably labeled polynucleotide. A variety of labels and labeling methods for polynucleotides are known in the art and can be used in the assay methods of the invention. Specificity of hybridization can be determined by comparison to appropriate controls.

Polynucleotides generally comprising at least 10 nt, at least 12 nt or at least 15 contiguous nucleotides of a polynucleotide provided herein, such as, for example, those having the sequence as depicted in Tables 1-27, are used for a variety of purposes, such as probes for detection of and/or measurement of, transcription levels of a polynucleotide that is differentially expressed in a prostate cancer cell. As will be readily appreciated by the ordinarily skilled artisan, the probe can be detectably labeled and contacted with, for example, an array comprising immobilized polynucleotides obtained from a test sample (e.g., mRNA). Alternatively, the probe can be immobilized on an array and the test sample detectably labeled. These and other variations of the methods of the invention are well within the skill in the art and are within the scope of the invention.

Nucleotide probes are used to detect expression of a gene corresponding to the provided polynucleotide. In Northern blots, mRNA is separated electrophoretically and contacted with a probe. A probe is detected as hybridizing to an mRNA species of a particular size. The amount of hybridization can be quantitated to determine relative amounts of expression, for example under a particular condition. Probes are used for in situ hybridization to cells to detect expression. Probes can also be used in vivo for diagnostic detection of hybridizing sequences. Probes are typically labeled with a radioactive isotope. Other types of detectable labels can be used such as chromophores, fluorophores, and enzymes. Other examples of nucleotide hybridization assays are described in WO92/02526 and U.S. Pat. No. 5,124,246.

PCR is another means for detecting small amounts of target nucleic acids (see, e.g., Mullis et al., *Meth. Enzymol.* (1987) 155:335; U.S. Pat. No. 4,683,195; and U.S. Pat. No. 4,683,202). Two primer oligonucleotides that hybridize with the target nucleic acids are used to prime the reaction. The primers can be composed of sequence within or 3' and 5' to the CA polynucleotides disclosed herein. Alternatively, if the primers are 3' and 5' to these polynucleotides, they need not hybridize to them or the complements. After amplification of the target with a thermostable polymerase, the amplified target nucleic acids can be detected by methods known in the art, e.g., Southern blot. mRNA or cDNA can also be detected by traditional blotting techniques (e.g., Southern blot, Northern blot, etc.) described in Sambrook et al., "Molecular Cloning:

A Laboratory Manual" (New York, Cold Spring Harbor Laboratory, 1989) (e.g., without PCR amplification). In general, mRNA or cDNA generated from mRNA using a polymerase enzyme can be purified and separated using gel electrophoresis, and transferred to a solid support, such as nitrocellulose. The solid support is exposed to a labeled probe, washed to remove any unhybridized probe, and duplexes containing the labeled probe are detected.

Methods using PCR amplification can be performed on the DNA from a single cell, although it is convenient to use at least about $10^5$ cells. The use of the polymerase chain reaction is described in Saiki et al. (1985) *Science* 239:487, and a review of current techniques may be found in Sambrook, et al. *Molecular Cloning: A Laboratory Manual*, CSH Press 1989, pp. 14.2-14.33. A detectable label may be included in the amplification reaction. Suitable detectable labels include fluorochromes, (e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein, 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA)), radioactive labels, (e.g. $^{32}P$, $^{35}S$, $^3H$, etc.), and the like. The label may be a two stage system, where the polynucleotides is conjugated to biotin, haptens, etc. having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

The detection methods can be provided as part of a kit. Thus, the invention further provides kits for detecting the presence and/or a level of a polynucleotide that is differentially expressed in a cancer cell (e.g., by detection of an mRNA encoded by the differentially expressed gene of interest), and/or a polypeptide encoded thereby, in a biological sample. Procedures using these kits can be performed by clinical laboratories, experimental laboratories, medical practitioners, or private individuals. The kits of the invention for detecting a polypeptide encoded by a polynucleotide that is differentially expressed in a cancer cell may comprise a moiety that specifically binds the polypeptide, which may be an antibody that binds the polypeptide or fragment thereof. The kits of the invention used for detecting a polynucleotide that is differentially expressed in a prostate cancer cell may comprise a moiety that specifically hybridizes to such a polynucleotide. The kit may optionally provide additional components that are useful in the procedure, including, but not limited to, buffers, developing reagents, labels, reacting surfaces, means for detection, control samples, standards, instructions, and interpretive information. Accordingly, the present invention provides kits for detecting prostate cancer comprising at least one of polynucleotides having the sequence as shown in Tables 1-27 or fragments thereof.

The present invention further relates to methods of detecting/diagnosing a neoplastic or preneoplastic condition in a mammal (for example, a human). "Diagnosis" as used herein generally includes determination of a subject's susceptibility to a disease or disorder, determination as to whether a subject is presently affected by a disease or disorder, prognosis of a subject affected by a disease or disorder (e.g., identification of pre-metastatic or metastatic cancerous states, stages of cancer, or responsiveness of cancer to therapy), and therametrics (e.g., monitoring a subject's condition to provide information as to the effect or efficacy of therapy).

The terms "treatment", "treating", "treat" and the like are used herein to generally refer to obtaining a desired pharmacologic and/or physiologic effect. The effect may be prophylactic in terms of completely or partially preventing a disease or symptom thereof and/or may be therapeutic in terms of a partial or complete stabilization or cure for a disease and/or adverse effect attributable to the disease. "Treatment" as used herein covers any treatment of a disease in a mammal, particularly a human, and includes: (a) preventing the disease or symptom from occurring in a subject which may be predisposed to the disease or symptom but has not yet been diagnosed as having it; (b) inhibiting the disease symptom, i.e., arresting its development; or (c) relieving the disease symptom, i.e., causing regression of the disease or symptom.

An "effective amount" is an amount sufficient to effect beneficial or desired results, including clinical results. An effective amount can be administered in one or more administrations.

A "cell sample" encompasses a variety of sample types obtained from an individual and can be used in a diagnostic or monitoring assay. The definition encompasses blood and other liquid samples of biological origin, solid tissue samples such as a biopsy specimen or tissue cultures or cells derived therefrom, and the progeny thereof. The definition also includes samples that have been manipulated in any way after their procurement, such as by treatment with reagents, solubilization, or enrichment for certain components, such as proteins or polynucleotides. The term "cell sample" encompasses a clinical sample, and also includes cells in culture, cell supernatants, cell lysates, serum, plasma, biological fluid, and tissue samples.

As used herein, the terms "neoplastic cells", "neoplasia", "tumor", "tumor cells", "cancer" and "cancer cells", (used interchangeably) refer to cells which exhibit relatively autonomous growth, so that they exhibit an aberrant growth phenotype characterized by a significant loss of control of cell proliferation (i.e., de-regulated cell division). Neoplastic cells can be malignant or benign.

The terms "individual," "subject," "host," and "patient," are used interchangeably herein and refer to any mammalian subject for whom diagnosis, treatment, or therapy is desired, particularly humans. Other subjects may include cattle, dogs, cats, guinea pigs, rabbits, rats, mice, horses, and so on. Examples of conditions that can be detected/diagnosed in accordance with these methods include cancers. Polynucleotides corresponding to genes that exhibit the appropriate expression pattern can be used to detect cancer in a subject. For a review of markers of cancer, see, e.g., Hanahan et al. Cell 100:57-70 (2000).

One detection/diagnostic method comprises: (a) obtaining from a mammal (e.g., a human) a biological sample, (b) detecting the presence in the sample of a CA protein and (c) comparing the amount of product present with that in a control sample. In accordance with this method, the presence in the sample of elevated levels of a CA gene product indicates that the subject has a neoplastic or preneoplastic condition.

Biological samples suitable for use in this method include biological fluids such as serum, plasma, pleural effusions, urine and cerebro-spinal fluid, CSF, tissue samples (e.g., mammary tumor or prostate tissue slices) can also be used in the method of the invention, including samples derived from biopsies. Cell cultures or cell extracts derived, for example, from tissue biopsies can also be used.

The compound is preferably a binding protein, e.g., an antibody, polyclonal or monoclonal, or antigen binding fragment thereof, which can be labeled with a detectable marker (e.g., fluorophore, chromophore or isotope, etc). Where appropriate, the compound can be attached to a solid support such as a bead, plate, filter, resin, etc. Determination of formation of the complex can be effected by contacting the complex with a further compound (e.g., an antibody) that specifically binds to the first compound (or complex). Like the first compound, the further compound can be attached to a solid support and/or can be labeled with a detectable marker.

The identification of elevated levels of CA protein in accordance with the present invention makes possible the identification of subjects (patients) that are likely to benefit from adjuvant therapy. For example, a biological sample from a post primary therapy subject (e.g., subject having undergone surgery) can be screened for the presence of circulating CA protein, the presence of elevated levels of the protein, determined by studies of normal populations, being indicative of residual tumor tissue. Similarly, tissue from the cut site of a surgically removed tumor can be examined (e.g., by immunofluorescence), the presence of elevated levels of product (relative to the surrounding tissue) being indicative of incomplete removal of the tumor. The ability to identify such subjects makes it possible to tailor therapy to the needs of the particular subject. Subjects undergoing non-surgical therapy, e.g., chemotherapy or radiation therapy, can also be monitored, the presence in samples from such subjects of elevated levels of CA protein being indicative of the need for continued treatment. Staging of the disease (for example, for purposes of optimizing treatment regimens) can also be effected, for example, by biopsy e.g., with antibody specific for a CA protein.

(f) Animal Models and Transgenics

In another preferred embodiment CA genes find use in generating animal models of cancers, particularly lymphomas and carcinomas. As is appreciated by one of ordinary skill in the art, when the CA gene identified is repressed or diminished in CA tissue, gene therapy technology wherein antisense RNA directed to the CA gene will also diminish or repress expression of the gene. An animal generated as such serves as an animal model of CA that finds use in screening bioactive drug candidates. Similarly, gene knockout technology, for example as a result of homologous recombination with an appropriate gene targeting vector, will result in the absence of the CA protein. When desired, tissue-specific expression or knockout of the CA protein may be necessary.

It is also possible that the CA protein is overexpressed in cancer. As such, transgenic animals can be generated that overexpress the CA protein. Depending on the desired expression level, promoters of various strengths can be employed to express the transgene. Also, the number of copies of the integrated transgene can be determined and compared for a determination of the expression level of the transgene. Animals generated by such methods find use as animal models of CA and are additionally useful in screening for bioactive molecules to treat cancer.

Characterization of CA Sequences

The CA nucleic acid sequences of the invention are depicted in Tables 1-27. The sequences in each Table include genomic DNA sequence (mouse genomic sequences mDxx-yyy; human genomic sequences hDxx-yyy), sequence corresponding to the mRNA(s) generated therefrom (mRxx-yyy; hRxx-yyy) and amino acid sequences of the proteins (mPxx-yyy; hPxx-yyy encoded by the mRNA for both mouse and human genes. N/A indicates a gene that has been identified, but for which there has not been a name ascribed.

The mouse and human genomic DNA sequence, sequence corresponding to the mRNA(s) generated therefrom and amino acid sequences of the proteins as shown in Tables 1-27 are described according to SEQ ID NOS as follows in Table 28.

TABLE 28

| DESIGNATION | SEQ ID NO | TYPE OF SEQUENCE |
|---|---|---|
| mD07-23a | SEQ ID NO: 1 | mouse genomic sequence |
| mR07-23a | SEQ ID NO: 2 | mouse mRNA sequence |
| mP07-23a | SEQ ID NO: 3 | mouse protein sequence |
| hD07-23a | SEQ ID NO: 4 | human genomic sequence |
| hR07-23a | SEQ ID NO: 5 | human mRNA sequence |
| hP07-23a | SEQ ID NO: 6 | human protein sequence |
| mD07-24a | SEQ ID NO: 7 | mouse genomic sequence |
| mR07-24a | SEQ ID NO: 8 | mouse mRNA sequence |
| mP07-24a | SEQ ID NO: 9 | mouse protein sequence |
| hD07-24a | SEQ ID NO: 10 | human genomic sequence |
| hR07-24a | SEQ ID NO: 11 | human mRNA sequence |
| hP07-24a | SEQ ID NO: 12 | human protein sequence |
| mD07-24a | SEQ ID NO: 13 | mouse genomic sequence |
| mR07-24a | SEQ ID NO: 14 | mouse mRNA sequence |
| mP07-24a | SEQ ID NO: 15 | mouse protein sequence |
| hD07-24a | SEQ ID NO: 16 | human genomic sequence |
| hR07-24a.1 | SEQ ID NO: 17 | human mRNA sequence |
| hP07-24a.1 | SEQ ID NO: 18 | human protein sequence |
| hR07-24a.2 | SEQ ID NO: 19 | human mRNA sequence |
| hP07-24a.2 | SEQ ID NO: 20 | human protein sequence |
| hR07-24a.3 | SEQ ID NO: 21 | human mRNA sequence |
| hP07-24a.3 | SEQ ID NO: 22 | human protein sequence |
| mD07-125a | SEQ ID NO: 23 | mouse genomic sequence |
| mR07-125a | SEQ ID NO: 24 | mouse mRNA sequence |
| mP07-125a | SEQ ID NO: 25 | mouse protein sequence |
| hD07-125a | SEQ ID NO: 26 | human genomic sequence |
| hR07-125a | SEQ ID NO: 27 | human mRNA sequence |
| hP07-125a | SEQ ID NO: 28 | human protein sequence |
| mD07-153a | SEQ ID NO: 29 | mouse genomic sequence |
| mR07-153a | SEQ ID NO: 30 | mouse mRNA sequence |
| mP07-153a | SEQ ID NO: 31 | mouse protein sequence |
| hD07-153a | SEQ ID NO: 32 | human genomic sequence |
| hR07-153a | SEQ ID NO: 33 | human mRNA sequence |
| hP07-153a | SEQ ID NO: 34 | human protein sequence |
| mD07-204a | SEQ ID NO: 35 | mouse genomic sequence |
| mR07-204a | SEQ ID NO: 36 | mouse mRNA sequence |
| mP07-204a | SEQ ID NO: 37 | mouse protein sequence |
| hD07-204a | SEQ ID NO: 38 | human genomic sequence |
| hR07-204a | SEQ ID NO: 39 | human mRNA sequence |
| hP07-204a | SEQ ID NO: 40 | human protein sequence |
| mD07-205a | SEQ ID NO: 41 | mouse genomic sequence |
| mR07-205a.1 | SEQ ID NO: 42 | mouse mRNA sequence |
| mP07-205a.1 | SEQ ID NO: 43 | mouse protein sequence |
| mR07-205a.2 | SEQ ID NO: 44 | mouse mRNA sequence |
| mP07-205a.2 | SEQ ID NO: 45 | mouse protein sequence |
| mR07-205a.3 | SEQ ID NO: 46 | mouse mRNA sequence |
| mP07-205a.3 | SEQ ID NO: 47 | mouse protein sequence |
| mR07-205a.4 | SEQ ID NO: 48 | mouse mRNA sequence |
| mP07-205a.4 | SEQ ID NO: 49 | mouse protein sequence |
| hD07-205a | SEQ ID NO: 50 | human genomic sequence |
| hR07-205a | SEQ ID NO: 51 | human mRNA sequence |
| hP07-205a | SEQ ID NO: 52 | human protein sequence |
| mD07-210a | SEQ ID NO: 53 | mouse genomic sequence |
| mR07-210a | SEQ ID NO: 54 | mouse mRNA sequence |
| mP07-210a | SEQ ID NO: 55 | mouse protein sequence |
| hD07-210a | SEQ ID NO: 56 | human genomic sequence |
| hR07-210a.1 | SEQ ID NO: 57 | human mRNA sequence |
| hP07-210a.1 | SEQ ID NO: 58 | human protein sequence |
| hR07-210a.2 | SEQ ID NO: 59 | human mRNA sequence |
| hP07-210a.2 | SEQ ID NO: 60 | human protein sequence |
| hP07-210a.3 | SEQ ID NO: 61 | human mRNA sequence |
| hP07-210a.3 | SEQ ID NO: 62 | human protein sequence |
| mD07-211a | SEQ ID NO: 63 | mouse genomic sequence |
| mR07-211a | SEQ ID NO: 64 | mouse mRNA sequence |
| mP07-211a | SEQ ID NO: 65 | mouse protein sequence |
| hD07-211a | SEQ ID NO: 66 | human genomic sequence |
| hR07-211a.1 | SEQ ID NO: 67 | human mRNA sequence |
| hP07-211a.1 | SEQ ID NO: 68 | human protein sequence |
| hR07-211a.2 | SEQ ID NO: 69 | human mRNA sequence |
| hP07-211a.2 | SEQ ID NO: 70 | human protein sequence |
| mD07-220a | SEQ ID NO: 71 | mouse genomic sequence |
| mR07-220a | SEQ ID NO: 72 | mouse mRNA sequence |
| mP07-220a | SEQ ID NO: 73 | mouse protein sequence |
| hD07-220a.1 | SEQ ID NO: 74 | human genomic sequence |
| hR07-220a.1 | SEQ ID NO: 75 | human mRNA sequence |
| hP07-220a.1 | SEQ ID NO: 76 | human protein sequence |
| hD07-220a.2 | SEQ ID NO: 77 | human genomic sequence |

TABLE 28-continued

| DESIGNATION | SEQ ID NO | TYPE OF SEQUENCE |
|---|---|---|
| hR07-220a.2 | SEQ ID NO: 78 | human mRNA sequence |
| hP07-220a.2 | SEQ ID NO: 79 | human protein sequence |
| mD07-221a | SEQ ID NO: 80 | mouse genomic sequence |
| mR07-221a | SEQ ID NO: 81 | mouse mRNA sequence |
| mP07-221a | SEQ ID NO: 82 | mouse protein sequence |
| hD07-221a | SEQ ID NO: 83 | human genomic sequence |
| hR07-221a.1 | SEQ ID NO: 84 | human mRNA sequence |
| hP07-221a.1 | SEQ ID NO: 85 | human protein sequence |
| hR07-221a.2 | SEQ ID NO: 86 | human mRNA sequence |
| hP07-221a.2 | SEQ ID NO: 87 | human protein sequence |
| hR07-221a.3 | SEQ ID NO: 88 | human mRNA sequence |
| hP07-221a.3 | SEQ ID NO: 89 | human protein sequence |
| mD07-239a | SEQ ID NO: 90 | mouse genomic sequence |
| mR07-239a | SEQ ID NO: 91 | mouse mRNA sequence |
| mP07-239a | SEQ ID NO: 92 | mouse protein sequence |
| hD07-239a | SEQ ID NO: 93 | human genomic sequence |
| hR07-239a | SEQ ID NO: 94 | human mRNA sequence |
| hP07-239a | SEQ ID NO: 95 | human protein sequence |
| mD12-017 | SEQ ID NO: 96 | mouse genomic sequence |
| mR12-017 | SEQ ID NO: 97 | mouse mRNA sequence |
| mP12-017 | SEQ ID NO: 98 | mouse protein sequence |
| hD12-017 | SEQ ID NO: 99 | human genomic sequence |
| hR12-017 | SEQ ID NO: 100 | human mRNA sequence |
| hP12-017 | SEQ ID NO: 101 | human protein sequence |
| mD12-027 | SEQ ID NO: 102 | mouse genomic sequence |
| mR12-027 | SEQ ID NO: 103 | mouse mRNA sequence |
| mP12-027 | SEQ ID NO: 104 | mouse protein sequence |
| hD12-027 | SEQ ID NO: 105 | human genomic sequence |
| hR12-027 | SEQ ID NO: 106 | human mRNA sequence |
| hP12-027 | SEQ ID NO: 107 | human protein sequence |
| mD13-010 | SEQ ID NO: 108 | mouse genomic sequence |
| mR13-010 | SEQ ID NO: 109 | mouse mRNA sequence |
| mP13-010 | SEQ ID NO: 110 | mouse protein sequence |
| hD13-010 | SEQ ID NO: 111 | human genomic sequence |
| hR13-010 | SEQ ID NO: 112 | human mRNA sequence |
| hP13-010 | SEQ ID NO: 113 | human protein sequence |
| mD13-011 | SEQ ID NO: 114 | mouse genomic sequence |
| mR13-011 | SEQ ID NO: 115 | mouse mRNA sequence |
| mP13-011 | SEQ ID NO: 116 | mouse protein sequence |
| hD13-011 | SEQ ID NO: 117 | human genomic sequence |
| hR13-011.1 | SEQ ID NO: 118 | human mRNA sequence |
| hP13-011.1 | SEQ ID NO: 119 | human protein sequence |
| hR13-011.2 | SEQ ID NO: 120 | human mRNA sequence |
| hP13-011.2 | SEQ ID NO: 121 | human protein sequence |
| mD13-017 | SEQ ID NO: 122 | mouse genomic sequence |
| mR13-017 | SEQ ID NO: 123 | mouse mRNA sequence |
| mP13-017 | SEQ ID NO: 124 | mouse protein sequence |
| hD13-017 | SEQ ID NO: 125 | human genomic sequence |
| hR13-017 | SEQ ID NO: 126 | human mRNA sequence |
| hP13-017 | SEQ ID NO: 127 | human protein sequence |
| mD13-019 | SEQ ID NO: 128 | mouse genomic sequence |
| mR13-019.1 | SEQ ID NO: 129 | mouse mRNA sequence |
| mP13-019.1 | SEQ ID NO: 130 | mouse protein sequence |
| mR13-019.2 | SEQ ID NO: 131 | mouse mRNA sequence |
| mP13-019.2 | SEQ ID NO: 132 | mouse protein sequence |
| hD13-019 | SEQ ID NO: 133 | human genomic sequence |
| hR13-019 | SEQ ID NO: 134 | human mRNA sequence |
| hP13-019 | SEQ ID NO: 135 | human protein sequence |
| mD13-023 | SEQ ID NO: 136 | mouse genomic sequence |
| mR13-023 | SEQ ID NO: 137 | mouse mRNA sequence |
| mP13-023 | SEQ ID NO: 138 | mouse protein sequence |
| hD13-023 | SEQ ID NO: 139 | human genomic sequence |
| hR13-023 | SEQ ID NO: 140 | human mRNA sequence |
| hP13-023 | SEQ ID NO: 141 | human protein sequence |
| mD13-026 | SEQ ID NO: 142 | mouse genomic sequence |
| mR13-026 | SEQ ID NO: 143 | mouse mRNA sequence |
| mP13-026 | SEQ ID NO: 144 | mouse protein sequence |
| hD13-026 | SEQ ID NO: 145 | human genomic sequence |
| hR13-026 | SEQ ID NO: 146 | human mRNA sequence |
| hP13-026 | SEQ ID NO: 147 | human protein sequence |
| mD13-028 | SEQ ID NO: 148 | mouse genomic sequence |
| mR13-028 | SEQ ID NO: 149 | mouse mRNA sequence |
| mP13-028 | SEQ ID NO: 150 | mouse protein sequence |
| hD13-028 | SEQ ID NO: 151 | human genomic sequence |
| hR13-028.1 | SEQ ID NO: 152 | human mRNA sequence |
| hP13-028.1 | SEQ ID NO: 153 | human protein sequence |
| hR13-028.2 | SEQ ID NO: 154 | human mRNA sequence |
| hP13-028.2 | SEQ ID NO: 155 | human protein sequence |
| hR13-028.3 | SEQ ID NO: 156 | human mRNA sequence |
| hP13-028.3 | SEQ ID NO: 157 | human protein sequence |
| hR13-028.4 | SEQ ID NO: 158 | human mRNA sequence |
| hP13-028.4 | SEQ ID NO: 159 | human protein sequence |
| mD13-036 | SEQ ID NO: 160 | mouse genomic sequence |
| mR13-036 | SEQ ID NO: 161 | mouse mRNA sequence |
| mP13-036 | SEQ ID NO: 162 | mouse protein sequence |
| hD13-036 | SEQ ID NO: 163 | human genomic sequence |
| hR13-036 | SEQ ID NO: 164 | human mRNA sequence |
| hP13-036 | SEQ ID NO: 165 | human protein sequence |
| mD13-060 | SEQ ID NO: 166 | mouse genomic sequence |
| mR13-060 | SEQ ID NO: 167 | mouse mRNA sequence |
| mP13-060 | SEQ ID NO: 168 | mouse protein sequence |
| hD13-060 | SEQ ID NO: 169 | human genomic sequence |
| hR13-060.1 | SEQ ID NO: 170 | human mRNA sequence |
| hP13-060.1 | SEQ ID NO: 171 | human protein sequence |
| hR13-060.2 | SEQ ID NO: 172 | human mRNA sequence |
| hP13-060.2 | SEQ ID NO: 173 | human protein sequence |
| hR13-060.3 | SEQ ID NO: 174 | human mRNA sequence |
| hP13-060.3 | SEQ ID NO: 175 | human protein sequence |
| mD13-065 | SEQ ID NO: 176 | mouse genomic sequence |
| mR13-065 | SEQ ID NO: 177 | mouse mRNA sequence |
| mP13-065 | SEQ ID NO: 178 | mouse protein sequence |
| hD13-065 | SEQ ID NO: 179 | human genomic sequence |
| hR13-065.1 | SEQ ID NO: 180 | human mRNA sequence |
| hP13-065.1 | SEQ ID NO: 181 | human protein sequence |
| hR13-065.2 | SEQ ID NO: 182 | human mRNA sequence |
| hP13-065.2 | SEQ ID NO: 183 | human protein sequence |
| hR13-065.3 | SEQ ID NO: 184 | human mRNA sequence |
| hP13-065.3 | SEQ ID NO: 185 | human protein sequence |
| mD14-032 | SEQ ID NO: 186 | mouse genomic sequence |
| mR14-032 | SEQ ID NO: 187 | mouse mRNA sequence |
| mP14-032 | SEQ ID NO: 188 | mouse protein sequence |
| hD14-032 | SEQ ID NO: 189 | human genomic sequence |
| hR14-032 | SEQ ID NO: 190 | human mRNA sequence |
| hP14-032 | SEQ ID NO: 191 | human protein sequence |
| mD14-033 | SEQ ID NO: 192 | mouse genomic sequence |
| mR14-033 | SEQ ID NO: 193 | mouse mRNA sequence |
| mP14-033 | SEQ ID NO: 194 | mouse protein sequence |
| hD14-033 | SEQ ID NO: 195 | human genomic sequence |
| hR14-033 | SEQ ID NO: 196 | human mRNA sequence |
| hP14-033 | SEQ ID NO: 197 | human protein sequence |
| mD14-034 | SEQ ID NO: 198 | mouse genomic sequence |
| mR14-034 | SEQ ID NO: 199 | mouse mRNA sequence |
| mP14-034 | SEQ ID NO: 200 | mouse protein sequence |
| hD14-034 | SEQ ID NO: 201 | human genomic sequence |
| hR14-034 | SEQ ID NO: 202 | human mRNA sequence |
| hP14-034 | SEQ ID NO: 203 | human protein sequence |

The CA sequences were analyzed by Panther™ (Molecular Diagnostics, Palo Alto, Calif.) software designed to detect homologs and enable prediction of molecular function through a system for protein functional classification. Human Gene Ontlogy annotations were prepared in accordance with the Gene Ontology Consortium (Gene Ontology: tool for the unification of biology. The Gene Ontology Consortium *Nature Genet.* 25: 25-29 (2000)). Similar analysis was carried out by determining IPR information regarding the CA polypeptides from InterPro, which is an integrated documentation resource for protein families, domains and functional sites (Apweiler at al. Bioinformatics 16(12):1145-1150 (2000)).

The CA sequences may be classified according to the following predicted general classifications of function by Panther™ analysis, human gene ontology and IPR domain information for polypeptides SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203 shown in Tables 1-27.

TABLE 29

| HUMAN PROTEIN | CLASSIFICATION |
|---|---|
| hP07-023a (SEQ ID NO: 6) | HUMAN PANTHER CLASSIFICATIONS<br>No Panther Hit<br>HUMAN GENE ONTOLOGY<br>PROCESS<br>stress response > defence response<br>developmental processes > fertilization<br>FUNCTION<br>molecular_function unknown > lymphocyte antigen<br>ligand binding or carrier > calcium binding<br>LOCATION<br>cell > plasma membrane<br>cell > membrane fraction<br>lysosome > lysosomal membrane<br>HUMAN PROTEIN DOMAINS (INTERPRO SIGNATURES)<br>IPR000082 (SEA )<br>NULL (THR RICH )<br>IPR000561 (EGF 2) |
| hP07-24a (SEQ ID NO: 12) | HUMAN PANTHER CLASSIFICATIONS<br>FAMILY (SUBFAMILY)<br>CELL SURFACE GLYCOPROTEIN MUC18-RELATEDHUMAN GENE ONTOLOGY<br>PROCESS<br>cell communication > cell adhesion<br>defence response > immune response<br>neurogenesis > central nervous system development<br>transcription, DNA-dependent > transcription regulation<br>microtubule-based process<br>nuclear congression<br>peptidoglycan catabolism > microtubule-based movement<br>FUNCTION<br>B cell receptor<br>defense/immunity protein > immunoglobulin<br>enzyme > nitric oxide synthase<br>GO molecular function > cell adhesion<br>GO molecular function > cell adhesion<br>nucleic acid binding > DNA binding<br>LOCATION<br>cell > membrane fraction<br>cell > plasma membrane<br>plasma membrane > integral plasma membrane protein<br>mitochondrial membrane > mitochondrial inner membrane<br>adherens junction > cell-cell adherens junction<br>HUMAN PROTEIN DOMAINS (INTERPRO SIGNATURES)<br>IPR003599 (IG)<br>IPR003006 (ig) |
| hP07-053a.1 (SEQ ID NO: 18) | HUMAN PANTHER CLASSIFICATIONS<br>FAMILY (SUBFAMILY)<br>TUMOR NECROSIS FACTOR-RELATED (TNF-RELATED APOPTOSIS INDUCING LIGAND)<br>MOLECULAR FUNCTIONS<br>Signaling molecule > Cytokine > Other cytokine<br>BIOLOGICAL PROCESS<br>Signal transduction > Intracellular signaling cascade > NF-kappaB cascade<br>Signal transduction > Cell communication > Ligand-mediated signaling<br>Signal transduction > Cell surface receptor mediated signal transduction > Cytokine and chemokine mediated signaling pathway<br>Apoptosis > Induction of apoptosis<br>HUMAN GENE ONTOLOGY<br>PROCESS<br>cell death > apoptosis<br>defence response > immune response<br>apoptosis > induction of apoptosis<br>cell communication > signal transduction<br>cell communication > cell-cell signaling<br>FUNCTION<br>molecular_function unknown > lymphocyte antigen |

TABLE 29-continued

| HUMAN PROTEIN | CLASSIFICATION |
|---|---|
| | LOCATION<br>cell > membrane fraction<br>cell > soluble fraction<br>plasma membrane > integral plasma membrane protein<br>HUMAN PROTEIN DOMAINS (INTERPRO SIGNATURES)<br>IPR003263 (sp P50591 TRAI HUMAN) |
| hP07-053a.2<br>(SEQ ID NO: 20) | HUMAN PANTHER CLASSIFICATIONS<br>FAMILY (SUBFAMILY)<br>TUMOR NECROSIS FACTOR-RELATED<br>(TNF-RELATED APOPTOSIS INDUCING LIGAND)<br>MOLECULAR FUNCTIONS<br>Signaling molecule > Cytokine > Other cytokine<br>BIOLOGICAL PROCESS<br>Signal transduction > Intracellular signaling cascade > NF-kappaB cascade<br>Signal transduction > Cell communication > Ligand-mediated signaling<br>Signal transduction > Cell surface receptor mediated signal transduction > Cytokine and chemokine mediated signaling pathway<br>Apoptosis > Induction of apoptosis<br>HUMAN GENE ONTOLOGY<br>PROCESS<br>cell death > apoptosis<br>defence response > immune response<br>apoptosis > induction of apoptosis<br>cell communication > signal transduction<br>cell communication > cell-cell signaling<br>FUNCTION<br>molecular_function unknown > lymphocyte antigen<br>LOCATION<br>cell > membrane fraction<br>cell > soluble fraction<br>plasma membrane > integral plasma membrane protein<br>HUMAN PROTEIN DOMAINS (INTERPRO SIGNATURES)<br>IPR003263 (sp P50591 TRAI HUMAN) |
| hP07-053a.3<br>(SEQ ID NO: 22) | HUMAN PANTHER CLASSIFICATIONS<br>FAMILY (SUBFAMILY)<br>TUMOR NECROSIS FACTOR-<br>RELATED(TNF-RELATED APOPTOSIS INDUCING LIGAND)<br>MOLECULAR FUNCTIONS<br>Signaling molecule > Cytokine > Other cytokine<br>BIOLOGICAL PROCESS<br>Signal transduction > Intracellular signaling cascade > NF-kappaB cascade<br>Signal transduction > Cell communication > Ligand-mediated signaling<br>Signal transduction > Cell surface receptor mediated signal transduction > Cytokine and chemokine mediated signaling pathway<br>Apoptosis > Induction of apoptosis<br>HUMAN GENE ONTOLOGY<br>PROCESS<br>defence response > immune response<br>cell death > apoptosis<br>apoptosis > induction of apoptosis<br>cell communication > signal transduction<br>cell communication > cell-cell signaling<br>FUNCTION<br>molecular_function unknown > lymphocyte antigen<br>enzyme > nitric oxide synthase<br>GO molecular function > cell cycle regulator<br>enzyme > protein kinase<br>nucleotide binding > ATP binding<br>LOCATION<br>cell > membrane fraction<br>plasma membrane > integral plasma membrane protein<br>cell > soluble fraction<br>GO cellular component > extracellular<br>mitochondrial membrane > mitochondrial inner |

TABLE 29-continued

| HUMAN PROTEIN | CLASSIFICATION |
|---|---|
| | membrane |
| | HUMAN PROTEIN DOMAINS (INTERPRO SIGNATURES) |
| | IPR000478 (TNF) |
| | IPR000478 (TNF) |
| | IPR000478 (TNF 2) |
| | IPR000478 (TNF 1) |
| | IPR003263 (sp P50591 TRAI HUMAN) |
| | IPR003636 (sp P41047 FASL MOUSE) |
| hP07-125a (SEQ ID NO: 28) | HUMAN PANTHER CLASSIFICATIONS FAMILY (SUBFAMILY) |
| | CD40L RECEPTOR-RELATED(CD27L RECEPTOR) |
| | MOLECULAR FUNCTIONS |
| | Molecular function unclassified |
| | BIOLOGICAL PROCESS |
| | Immunity and defense > T-cell mediated immunity |
| | HUMAN GENE ONTOLOGY |
| | PROCESS |
| | induction of apoptosis by extracellular signals > induction of apoptosis via death domain receptors |
| | cell death > apoptosis |
| | apoptosis > anti-apoptosis |
| | apoptosis > induction of apoptosis |
| | cell communication > signal transduction |
| | FUNCTION |
| | glycosaminoglycan binding > hyaluronic acid binding |
| | GO molecular function > apoptosis inhibitor |
| | O-glucosyl hydrolase |
| | antimicrobial response protein > lysozyme |
| | molecular_function unknown > lymphocyte antigen |
| | electron carrier > iron-sulfur electron transfer carrier |
| | LOCATION |
| | cell > membrane fraction |
| | cell > plasma membrane |
| | plasma membrane > integral plasma membrane protein |
| | integral plasma membrane protein > integral plasma membrane proteoglycan |
| | cell > soluble fraction |
| | HUMAN PROTEIN DOMAINS (INTERPRO SIGNATURES) |
| | IPR001368 (TNFR) |
| | IPR001368 (TNFR c6) |
| | IPR001368 (TNFR NGFR 2) |
| | NULL (CYS RICH) |
| | IPR000561 (EGF 2) |
| | IPR001368 (TNFR NGFR 1) |
| | IPR001368 (sp P26842 CD27 HUMAN) |
| hP14-034 (SEQ ID NO: 203) | HUMAN PANTHER CLASSIFICATIONS FAMILY (SUBFAMILY) |
| | INTERFERON INDUCIBLE TRANSMEMBRANE PROTEIN(INTERFERON INDUCIBLE TRANSMEMBRANE PROTEIN) |
| | MOLECULAR FUNCTIONS |
| | Molecular function unknown |
| | BIOLOGICAL PROCESS |
| | Cell proliferation and differentiation |
| | HUMAN GENE ONTOLOGY |
| | PROCESS |
| | defence response > immune response |
| | cell cycle > cell cycle control |
| | cell proliferation > negative control of cell proliferation |
| | FUNCTION |
| | defense/immunity protein > antiviral response protein |
| | LOCATION |
| | cell > membrane fraction |
| | cell > plasma membrane |
| | HUMAN PROTEIN DOMAINS (INTERPRO SIGNATURES) |
| | No Domain Hit |
| hP07-153a (SEQ ID NO: 34) | HUMAN PANTHER CLASSIFICATIONS FAMILY (SUBFAMILY) |

TABLE 29-continued

| HUMAN PROTEIN | CLASSIFICATION |
|---|---|
| | LAMININ-RELATEDHUMAN GENE ONTOLOGY<br>PROCESS<br>cell growth and maintenance > cell proliferation<br>protein metabolism and modification<br>macromolecule catabolism > proteolysis and peptidolysis<br>developmental processes > sex differentiation<br>cell communication > signal transduction<br>apoptotic program > caspase activation<br>FUNCTION<br>ligand binding or carrier > calcium binding<br>serine-type endopeptidase > trypsin<br>enzyme inhibitor > proteinase inhibitor<br>serine-type endopeptidase > trypsin<br>blood coagulation factor > protein C (activated)<br>serine-type endopeptidase > trypsin<br>HUMAN PROTEIN DOMAINS (INTERPRO SIGNATURES)<br>IPR002383 (GLABLOOD)<br>IPR000294 (GLA)<br>IPR001791 (LamG)<br>IPR000294 (gla)<br>IPR001791 (laminin G)<br>IPR001791 (LAM G DOMAIN 2)<br>IPR000294 (GLU CARBOXYLATION) |
| hP07-204a<br>(SEQ ID NO: 40) | HUMAN PANTHER CLASSIFICATIONS<br>FAMILY (SUBFAMILY)<br>WNT PROTEIN(WNT)<br>MOLECULAR FUNCTIONS<br>Signaling molecule > Other signaling molecule<br>BIOLOGICAL PROCESS<br>Developmental processes<br>HUMAN GENE ONTOLOGY<br>PROCESS<br>cell surface receptor linked signal transduction > fz2 receptor signaling pathway<br>GO biological process > developmental processes<br>developmental processes > embryogenesis and morphogenesis<br>cell communication > signal transduction<br>cell communication > cell-cell signaling<br>FUNCTION<br>GO molecular function > cell cycle regulator<br>LOCATION<br>extracellular > extracellular space<br>extracellular > extracellular matrix<br>cell > soluble fraction<br>HUMAN PROTEIN DOMAINS (INTERPRO SIGNATURES)<br>IPR000970 (WNTPROTEIN)<br>IPR000970 (WNT1)<br>IPR000970 (wnt)<br>NULL (CYS RICH)<br>IPR000970 (WNT1) |
| hP07-205a<br>(SEQ ID NO: 52) | HUMAN PANTHER CLASSIFICATIONS<br>FAMILY (SUBFAMILY)<br>PLATELET ENDOTHELIAL CELL ADHESION MOLECULE (PECAM-1)(PLATELET ENDOTHELIAL CELL ADHESION MOLECULE PRECURSOR (PECAM-1) (CD31 ANTIGEN))<br>MOLECULAR FUNCTIONS<br>Receptor<br>Cell adhesion molecule > Other cell adhesion molecule<br>Defense/immunity protein > Immunoglobulin receptor family member<br>BIOLOGICAL PROCESS<br>Cell adhesion<br>HUMAN GENE ONTOLOGY<br>PROCESS<br>cell growth and maintenance > cell motility<br>cell communication > cell recognition<br>cell communication > signal transduction<br>cell communication > cell adhesion<br>FUNCTION<br>B cell receptor<br>defense/immunity protein > immunoglobulin |

TABLE 29-continued

| HUMAN PROTEIN | CLASSIFICATION |
|---|---|
| | GO molecular function > cell adhesion
LOCATION
plasma membrane > intercellular junction
cell > plasma membrane
integral plasma membrane protein > integral
plasma membrane proteoglycan
cell > membrane fraction
HUMAN PROTEIN DOMAINS (INTERPRO SIGNATURES)
IPR003599 (IG)
IPR003006 (ig) |
| hP07-210a.1
(SEQ ID NO: 58)) | HUMAN PANTHER CLASSIFICATIONS
FAMILY (SUBFAMILY)
OLIGOPEPTIDE TRANSPORTER-RELATED
(gb def: (ab000280) peptide/histidine transporter [rattus norvegicus])
MOLECULAR FUNCTIONS
Molecular function unclassified
BIOLOGICAL PROCESS
Biological process unclassified
HUMAN GENE ONTOLOGY
PROCESS
peptide transport > oligopeptide transport
FUNCTION
serine carboxypeptidase > carboxypeptidase D
LOCATION
cell > membrane fraction
plasma membrane > integral plasma membrane protein
HUMAN PROTEIN DOMAINS (INTERPRO SIGNATURES)
IPR000109 (PTR2)
IPR000109 (PTR2 2)
IPR001117 (MULTICOPPER OXIDASE1) |
| hP07-210a.2
(SEQ ID NO: 60) | HUMAN PANTHER CLASSIFICATIONS
FAMILY (SUBFAMILY)
OLIGOPEPTIDE TRANSPORTER-RELATED
(gb def: (ab000280) peptide/histidine transporter [rattus norvegicus])
MOLECULAR FUNCTIONS
Molecular function unclassified
BIOLOGICAL PROCESS
Biological process unclassified
HUMAN GENE ONTOLOGY
PROCESS
peptide transport > oligopeptide transport
FUNCTION
serine carboxypeptidase > carboxypeptidase D
LOCATION
cell > membrane fraction
plasma membrane > integral plasma membrane protein
HUMAN PROTEIN DOMAINS (INTERPRO SIGNATURES)
IPR000109 (PTR2)
IPR000109 (PTR2 2)
IPR001117 (MULTICOPPER OXIDASE1) |
| hP07-210a.3
(SEQ ID NO: 62) | HUMAN PANTHER CLASSIFICATIONS
FAMILY (SUBFAMILY)
OLIGOPEPTIDE TRANSPORTER-
RELATED(gb def: (ab000280) peptide/histidine transporter [rattus norvegicus])
MOLECULAR FUNCTIONS
Molecular function unclassified
BIOLOGICAL PROCESS
Biological process unclassified
HUMAN GENE ONTOLOGY
PROCESS
peptide transport > oligopeptide transport
neurogenesis > central nervous system development
transcription, DNA-dependent > transcription regulation
cell death > apoptosis
microtubule-based process
nuclear congression
peptidoglycan catabolism > microtubule-based movement
FUNCTION |

TABLE 29-continued

| HUMAN PROTEIN | CLASSIFICATION |
|---|---|
| | serine carboxypeptidase > carboxypeptidase D
enzyme > nitric oxide synthase
GO molecular function > cell cycle regulator
ligand binding or carrier > electron transfer
enzyme > sarcosine dehydrogenase
LOCATION
cell > membrane fraction
plasma membrane > integral plasma membrane
protein
GO cellular component > extracellular
mitochondrial membrane > mitochondrial inner
membrane
extracellular > extracellular space
HUMAN PROTEIN DOMAINS (INTERPRO SIGNATURES)
IPR000109 (PTR2)
NULL (ALA RICH)
IPR000109 (PTR2 2)
IPR001117 (MULTICOPPER OXIDASE1) |
| hP07-211a.1 (SEQ ID NO: 68) | HUMAN PANTHER CLASSIFICATIONS
No Panther Hit
HUMAN GENE ONTOLOGY
No Gene Ontology
HUMAN PROTEIN DOMAINS (INTERPRO SIGNATURES)
No Domain Hit |
| hP07-211a.2 (SEQ ID NO: 70) | HUMAN PANTHER CLASSIFICATIONS
No Panther Hit
HUMAN GENE ONTOLOGY
No Gene Ontology
HUMAN PROTEIN DOMAINS (INTERPRO SIGNATURES)
IPR000282 (CR2A) |
| hP07-220a.1 (SEQ ID NO: 76) | HUMAN PANTHER CLASSIFICATIONS
FAMILY (SUBFAMILY)
INTERLEUKIN-1 RECEPTOR-
RELATED(INTERLEUKIN-1 RECEPTOR-RELATED)
MOLECULAR FUNCTIONS
Receptor > Cytokine receptor > Interleukin
receptor
BIOLOGICAL PROCESS
Signal transduction > Cell surface receptor
mediated signal transduction > Cytokine and chemokine
mediated signaling pathway
HUMAN GENE ONTOLOGY
FUNCTION
molecular_function unknown > lymphocyte
antigen
B cell receptor
defense/immunity protein > immunoglobulin
GO molecular function > cell adhesion
LOCATION
plasma membrane > integral plasma membrane
protein
cell > plasma membrane
cell > membrane fraction
HUMAN PROTEIN DOMAINS (INTERPRO SIGNATURES)
IPR000157 (TIR)
IPR000157 (TIR)
IPR003006 (ig)
IPR000157 (TOLL) |
| hP07-220a.2 (SEQ ID NO: 79) | HUMAN PANTHER CLASSIFICATIONS
FAMILY (SUBFAMILY)
INTERLEUKIN-1 RECEPTOR-
RELATED(INTERLEUKIN-1 RECEPTOR-RELATED)
MOLECULAR FUNCTIONS
Receptor > Cytokine receptor > Interleukin
receptor
BIOLOGICAL PROCESS
Signal transduction > Cell surface receptor
mediated signal transduction > Cytokine and chemokine
mediated signaling pathway
HUMAN GENE ONTOLOGY
FUNCTION
molecular_function unknown > lymphocyte
antigen
B cell receptor
defense/immunity protein > immunoglobulin
LOCATION |

TABLE 29-continued

| HUMAN PROTEIN | CLASSIFICATION |
|---|---|
| | plasma membrane > integral plasma membrane protein<br>cell > membrane fraction<br>HUMAN PROTEIN DOMAINS (INTERPRO SIGNATURES)<br>IPR003599 (IG) |
| hP07-221a.1 (SEQ ID NO: 85) | HUMAN PANTHER CLASSIFICATIONS<br>FAMILY (SUBFAMILY)<br>COLLAGEN ALPHA CHAIN (COLLAGEN ALPHA 5(IV) CHAIN)<br>MOLECULAR FUNCTIONS<br>Extracellular matrix > Extracellular matrix structural protein<br>BIOLOGICAL PROCESS<br>Biological process unclassified<br>HUMAN GENE ONTOLOGY<br>PROCESS<br>cell communication > cell adhesion<br>ectoderm development > epidermal differentiation<br>mesoderm development > skeletal development<br>complement activation > complement activation, classical pathway<br>sensory perception > hearing<br>FUNCTION<br>GO molecular function > cell adhesion<br>blood coagulation factor > protein C (activated)<br>serine-type endopeptidase<br>protein binding > collagen binding<br>defense/immunity protein > opsonin<br>proteinase inhibitor > serine protease inhibitor<br>LOCATION<br>fibrillar collagen > collagen type IV<br>extracellular matrix > basement membrane<br>extracellular matrix > collagen<br>fibrillar collagen > collagen type III<br>fibrillar collagen > collagen type I<br>HUMAN PROTEIN DOMAINS (INTERPRO SIGNATURES)<br>IPR000087 (Collagen)<br>NULL (GLY RICH)<br>IPR000694 (PRO RICH)<br>IPR000087 (COLLAGEN REP) |
| hP07-221a.2 (SEQ ID NO: 87) | HUMAN PANTHER CLASSIFICATIONS<br>FAMILY (SUBFAMILY)<br>COLLAGEN ALPHA CHAIN (COLLAGEN ALPHA 5(IV) CHAIN)<br>MOLECULAR FUNCTIONS<br>Extracellular matrix > Extracellular matrix structural protein<br>BIOLOGICAL PROCESS<br>Biological process unclassified<br>HUMAN GENE ONTOLOGY<br>PROCESS<br>cell communication > cell adhesion<br>ectoderm development > epidermal differentiation<br>mesoderm development > skeletal development<br>complement activation > complement activation, classical pathway<br>sensory perception > hearing<br>FUNCTION<br>GO molecular function > cell adhesion<br>blood coagulation factor > protein C (activated)<br>serine-type endopeptidase<br>protein binding > collagen binding<br>defense/immunity protein > opsonin<br>proteinase inhibitor > serine protease inhibitor<br>LOCATION<br>fibrillar collagen > collagen type IV<br>extracellular matrix > basement membrane<br>extracellular matrix > collagen<br>fibrillar collagen > collagen type III<br>fibrillar collagen > collagen type I<br>HUMAN PROTEIN DOMAINS (INTERPRO SIGNATURES)<br>IPR000087 (Collagen)<br>NULL (GLY RICH) |

TABLE 29-continued

| HUMAN PROTEIN | CLASSIFICATION |
|---|---|
| hP07-221a.3 (SEQ ID NO: 89) | IPR000694 (PRO RICH)<br>IPR000087 (COLLAGEN REP)<br>HUMAN PANTHER CLASSIFICATIONS<br>FAMILY (SUBFAMILY)<br>COLLAGEN ALPHA CHAIN(COLLAGEN ALPHA 5(IV) CHAIN)<br>MOLECULAR FUNCTIONS<br>Extracellular matrix > Extracellular matrix structural protein<br>BIOLOGICAL PROCESS<br>Biological process unclassified<br>HUMAN GENE ONTOLOGY<br>PROCESS<br>cell communication > cell adhesion<br>ectoderm development > epidermal differentiation<br>mesoderm development > skeletal development<br>complement activation > complement activation, classical pathway<br>sensory perception > hearing<br>FUNCTION<br>GO molecular function > cell adhesion<br>blood coagulation factor > protein C (activated) serine-type endopeptidase<br>protein binding > collagen binding<br>defense/immunity protein > opsonin<br>proteinase inhibitor > serine protease inhibitor<br>LOCATION<br>fibrillar collagen > collagen type IV<br>extracellular matrix > basement membrane<br>extracellular matrix > collagen<br>fibrillar collagen > collagen type III<br>fibrillar collagen > collagen type I<br>HUMAN PROTEIN DOMAINS (INTERPRO SIGNATURES)<br>IPR001442 (C4)<br>IPR000087 (Collagen)<br>IPR001442 (C4)<br>NULL (GLY RICH)<br>IPR000694 (PRO RICH)<br>IPR000087 (COLLAGEN REP)<br>IPR001442 (sp P29400 CA54 HUMAN) |
| hP07-239a (SEQ ID NO: 95) | HUMAN PANTHER CLASSIFICATIONS<br>FAMILY (SUBFAMILY)<br>SEMAPHORIN(SEMAPHORIN 6B)<br>MOLECULAR FUNCTIONS<br>Signaling molecule > Membrane-bound signaling molecule<br>BIOLOGICAL PROCESS<br>Signal transduction > Cell communication<br>Developmental processes > Ectoderm development > Neurogenesis<br>HUMAN GENE ONTOLOGY<br>PROCESS<br>ectoderm development > neurogenesis<br>peptidoglycan catabolism > axon guidance<br>axonogenesis<br>defence response > immune response<br>xenobiotic metabolism > drug resistance<br>cell adhesion<br>FUNCTION<br>GO molecular function > cell adhesion<br>B cell receptor<br>defense/immunity protein > immunoglobulin<br>cell adhesion<br>transmembrane receptor > cell adhesion receptor<br>glucosidase > mannosyl-oligosaccharide glucosidase (processing A-glucosidase I)<br>LOCATION<br>cell > membrane fraction<br>GO cellular component > extracellular<br>extracellular > extracellular space<br>integral plasma membrane protein > integrin<br>cytoplasm > endoplasmic reticulum<br>HUMAN PROTEIN DOMAINS (INTERPRO SIGNATURES)<br>IPR001627 (Sema) |

TABLE 29-continued

| HUMAN PROTEIN | CLASSIFICATION |
|---|---|
| hP12-017 (SEQ ID NO: 101) | HUMAN PANTHER CLASSIFICATIONS<br>FAMILY (SUBFAMILY)<br>CELL ADHESION MOLECULE-<br>RELATED(INTEGRAL MEMBRANE GLYCOPROTEIN)<br>MOLECULAR FUNCTIONS<br>MOLECULAR FUNCTION UNCLASSIFIED<br>BIOLOGICAL PROCESS<br>BIOLOGICAL PROCESS UNCLASSIFIED<br>HUMAN GENE ONTOLOGY<br>PROCESS<br>cell communication > cell adhesion<br>protein modification > protein dephosphorylation<br>protein modification > protein phosphorylation<br>protein kinase cascade > MAPKKK cascade<br>embryogenesis and morphogenesis > histogenesis<br>and organogenesis<br>FUNCTION<br>GO molecular function > cell adhesion<br>B cell receptor<br>defense/immunity protein > immunoglobulin<br>protein kinase > protein tyrosine kinase<br>nucleotide binding > ATP binding<br>enzyme > protein kinase<br>LOCATION<br>plasma membrane > integral plasma membrane<br>protein<br>cell > plasma membrane<br>cell > membrane fraction<br>extracellular > extracellular matrix<br>extracellular > extracellular space<br>HUMAN PROTEIN DOMAINS (INTERPRO SIGNATURES)<br>IPR001611 (LEURICHRPT)<br>IPR000372 (LRRNT)<br>IPR000483 (LRRCT)<br>IPR003006 (ig)<br>IPR000483 (LRRCT)<br>IPR003885 (LRR SD22)<br>NULL (LRR PS)<br>IPR003598 (IGc2)<br>IPR000372 (LRRNT)<br>IPR003599 (IG)<br>IPR003591 (LRR TYP)<br>IPR001611 (LRR) |
| hP12-027 (SEQ ID NO: 107) | HUMAN PANTHER CLASSIFICATIONS<br>FAMILY (SUBFAMILY)<br>NOT ANNOTATEDHUMAN GENE<br>ONTOLOGY<br>PROCESS<br>cell death > apoptosis<br>defence response > humoral defense mechanism<br>GO biological process > developmental processes<br>ectoderm development > epidermal<br>differentiation<br>cell communication > cell adhesion<br>FUNCTION<br>B cell receptor<br>defense/immunity protein > immunoglobulin<br>signaling (initiator) caspase > caspase-2<br>enzyme > sterol esterase<br>GO molecular function > enzyme<br>protein binding > profilin binding<br>LOCATION<br>cell > membrane fraction<br>extracellular > extracellular space<br>cell > nucleus<br>cytoplasm > cytoskeleton<br>cell > plasma membrane<br>HUMAN PROTEIN DOMAINS (INTERPRO SIGNATURES)<br>IPR003596 (IGv)<br>IPR003599 (IG)<br>IPR003006 (ig) |
| hP13-010 (SEQ ID NO: 113) | HUMAN PANTHER CLASSIFICATIONS<br>FAMILY (SUBFAMILY)<br>LEU RICH<br>GLYCOPROTEIN(FIBROMODULIN)<br>MOLECULAR FUNCTIONS |

TABLE 29-continued

| HUMAN PROTEIN | CLASSIFICATION |
|---|---|
| | Extracellular matrix > Other extracellular matrix<br>BIOLOGICAL PROCESS<br>Cell adhesion<br>HUMAN GENE ONTOLOGY<br>PROCESS<br>skeletal development > cartilage condensation<br>embryogenesis and morphogenesis > histogenesis<br>and organogenesis<br>mesoderm development > skeletal development<br>cell communication > cell adhesion<br>cell communication > signal transduction<br>FUNCTION<br>glycosaminoglycan binding > hyaluronic acid<br>binding<br>ligand binding or carrier > protein binding<br>GO molecular function > cell adhesion<br>ligand binding or carrier > glycosaminoglycan<br>binding<br>calcium binding > calcium sensing<br>LOCATION<br>extracellular > extracellular matrix<br>cell > plasma membrane<br>extracellular > extracellular space<br>cell > membrane fraction<br>plasma membrane > integral plasma membrane<br>protein<br>HUMAN PROTEIN DOMAINS (INTERPRO SIGNATURES)<br>IPR001611 (LEURICHRPT)<br>NULL (LRR BAC)<br>NULL (LRR PS)<br>IPR000372 (LRRNT)<br>IPR003591 (LRR TYP)<br>IPR001611 (LRR)<br>IPR000372 (LRRNT) |
| hP13-011.1 (SEQ ID NO: 119) | HUMAN PANTHER CLASSIFICATIONS<br>FAMILY (SUBFAMILY)<br>PROTEIN-TYROSINE PHOSPHATASE<br>(PROTEIN-TYROSINE PHOSPHATASE-CD45)<br>MOLECULAR FUNCTIONS<br>Receptor > Other receptor<br>Phosphatase > Protein phosphatase<br>BIOLOGICAL PROCESS<br>Protein metabolism and modification > Protein<br>modification > Protein phosphorylation<br>HUMAN GENE ONTOLOGY<br>PROCESS<br>protein modification > protein dephosphorylation<br>enzyme linked receptor protein signaling pathway > transmembrane<br>receptor protein tyrosine phosphatase<br>signaling pathway<br>isoprenoid catabolism > one-carbon compound<br>metabolism<br>defasciculation of neuron > defasciculation of<br>motor neuron<br>FUNCTION<br>protein tyrosine phosphatase > prenylated protein<br>tyrosine phosphatase<br>protein phosphatase > protein tyrosine<br>phosphatase<br>enzyme > protein phosphatase<br>transmembrane receptor<br>protein tyrosine phosphatase > prenylated protein<br>tyrosine phosphatase<br>protein tyrosine phosphatase > prenylated protein<br>tyrosine phosphatase<br>LOCATION<br>plasma membrane > integral plasma membrane<br>protein<br>cell > plasma membrane<br>cell > membrane fraction<br>cell > cytoplasm<br>cytoplasm > cytoskeleton<br>HUMAN PROTEIN DOMAINS (INTERPRO SIGNATURES)<br>IPR000242 (PRTYPHPHTASE)<br>IPR000242 (PTPc)<br>IPR003595 (PTPc motif) |

TABLE 29-continued

| HUMAN PROTEIN | CLASSIFICATION |
|---|---|
| | IPR000242 (Y phosphatase)<br>IPR000387 (TYR PHOSPHATASE 22)<br>IPR000242 (TYR PHOSPHATASE PTP 2)<br>IPR000387 (TYR PHOSPHATASE 1) |
| hP13-011.2<br>(SEQ ID NO: 121) | HUMAN PANTHER CLASSIFICATIONS<br>FAMILY (SUBFAMILY)<br>PROTEIN-TYROSINE<br>PHOSPHATASE(PROTEIN-TYROSINE PHOSPHATASE-<br>CD45)<br>MOLECULAR FUNCTIONS<br>Receptor > Other receptor<br>Phosphatase > Protein phosphatase<br>BIOLOGICAL PROCESS<br>Protein metabolism and modification > Protein<br>modification > Protein phosphorylation<br>HUMAN GENE ONTOLOGY<br>PROCESS<br>protein modification > protein dephosphorylation<br>enzyme linked receptor protein signaling pathway > transmembrane<br>receptor protein tyrosine phosphatase<br>signaling pathway<br>isoprenoid catabolism > one-carbon compound<br>metabolism<br>defasciculation of neuron > defasciculation of<br>motor neuron<br>FUNCTION<br>protein tyrosine phosphatase > prenylated protein<br>tyrosine phosphatase<br>protein phosphatase > protein tyrosine<br>phosphatase<br>enzyme > protein phosphatase<br>transmembrane receptor<br>protein tyrosine phosphatase > prenylated protein<br>tyrosine phosphatase<br>protein tyrosine phosphatase > prenylated protein<br>tyrosine phosphatase<br>LOCATION<br>plasma membrane > integral plasma membrane<br>protein<br>cell > plasma membrane<br>cell > membrane fraction<br>cell > cytoplasm<br>cytoplasm > cytoskeleton<br>HUMAN PROTEIN DOMAINS (INTERPRO SIGNATURES)<br>IPR000242 (PRTYPHPHTASE)<br>IPR000387 (TYR PHOSPHATASE 1)<br>IPR000242 (PTPc)<br>IPR001777 (FN3)<br>IPR003595 (PTPc motif)<br>IPR001777 (fn3)<br>IPR000242 (Y phosphatase)<br>IPR000387 (TYR PHOSPHATASE 22)<br>NULL (THR RICH)<br>IPR000242 (TYR PHOSPHATASE PTP 2) |
| hP13-017 (SEQ ID NO: 127) | HUMAN PANTHER CLASSIFICATIONS<br>FAMILY (SUBFAMILY)<br>INOSITOL 1,4,5-TRISPHOSPHATE<br>RECEPTOR(INOSITOL 1,4,5-TRISPHOSPHATE RECEPTOR<br>TYPE 2)<br>MOLECULAR FUNCTIONS<br>Receptor<br>Ion channel > Ligand-gated ion channel > Other<br>ligand-gated ion channel<br>BIOLOGICAL PROCESS<br>Signal transduction > Cell surface receptor<br>mediated signal transduction > G-protein mediated signaling<br>Transport > Ion transport > Cation transport<br>HUMAN GENE ONTOLOGY<br>PROCESS<br>di-, tri-valent inorganic cation transport > calcium<br>ion transport<br>ion transport > cation transport<br>cell communication > signal transduction<br>transport > ion transport<br>chemosensory perception > olfaction<br>FUNCTION |

TABLE 29-continued

| HUMAN PROTEIN | CLASSIFICATION |
|---|---|
| | enzyme > 1D-myo-inositol-trisphosphate 3-kinase |
| | ligand binding or carrier > calcium binding |
| | LOCATION |
| | cytoplasm > endoplasmic reticulum |
| | cell > membrane fraction |
| | cell > plasma membrane |
| | plasma membrane > brush border |
| | plasma membrane > integral plasma membrane protein |
| | HUMAN PROTEIN DOMAINS (INTERPRO SIGNATURES) |
| | IPR000493 (INSP3RECEPTR) |
| | IPR003608 (MIR) |
| | IPR000699 (RYDR ITPR) |
| | IPR001682 (CHANNEL PORE CA NA) |
| hP13-019 (SEQ ID NO: 135) | HUMAN PANTHER CLASSIFICATIONS |
| | FAMILY (SUBFAMILY) |
| | NKG2 TYPE II INTEGRAL MEMBRANE PROTEIN(NATURAL KILLER CELL SURFACE PROTEIN) |
| | MOLECULAR FUNCTIONS |
| | Receptor > Other receptor |
| | Defense/immunity protein > Other defense and immunity protein |
| | BIOLOGICAL PROCESS |
| | Immunity and defense > Natural killer cell mediated immunity |
| | HUMAN GENE ONTOLOGY |
| | PROCESS |
| | stress response > defence response |
| | humoral defense mechanism > antimicrobial response |
| | cell communication > cell adhesion |
| | defence response > cellular defense response |
| | FUNCTION |
| | molecular_function unknown > lymphocyte antigen |
| | sugar binding > lectin |
| | protein binding > lipoprotein binding |
| | GO molecular function > ligand binding or carrier |
| | defense/immunity protein > major histocompatibility complex antigen |
| | LOCATION |
| | cell > plasma membrane |
| | cell > membrane fraction |
| | plasma membrane > integral plasma membrane protein |
| | HUMAN PROTEIN DOMAINS (INTERPRO SIGNATURES) |
| | IPR001304 (CLECT) |
| | IPR001304 (lectin c) |
| | IPR001304 (C TYPE LECTIN 2) |
| hP13-023 (SEQ ID NO: 141) | HUMAN PANTHER CLASSIFICATIONS |
| | FAMILY (SUBFAMILY) |
| | NEUROTENSIN RECEPTOR-RELATED(G PROTEIN-COUPLED RECEPTOR) |
| | MOLECULAR FUNCTIONS |
| | Receptor > G-protein coupled receptor |
| | BIOLOGICAL PROCESS |
| | Signal transduction > Cell surface receptor mediated signal transduction > G-protein mediated signaling |
| | HUMAN GENE ONTOLOGY |
| | PROCESS |
| | cell surface receptor linked signal transduction > G protein linked receptor protein signaling pathway |
| | behavior > feeding behavior |
| | G protein signaling, linked to cAMP nucleotide second messenger > G protein signaling, adenylate cyclase inhibiting pathway |
| | G protein linked receptor protein signaling pathway > tachykinin signaling pathway |
| | G protein linked receptor protein signaling pathway > G protein signaling, linked to cyclic nucleotide second messenger |
| | FUNCTION |
| | enzyme > 2-acetyl-1-alkylglycerophosphocholine esterase |
| | 1-phosphatidylinositol 3-kinase > 1- |

TABLE 29-continued

| HUMAN PROTEIN | CLASSIFICATION |
|---|---|
| | phosphatidylinositol 3-kinase regulator |
| | transcription factor > RNA polymerase II transcription factor |
| | enzyme inhibitor > protein kinase inhibitor |
| | protein binding > lipoprotein binding |
| | LOCATION |
| | cell > membrane fraction |
| | plasma membrane > integral plasma membrane protein |
| | cell > plasma membrane |
| | cytoplasm > endoplasmic reticulum |
| | cytoplasm > Golgi apparatus |
| | HUMAN PROTEIN DOMAINS (INTERPRO SIGNATURES) |
| | IPR000276 (GPCRRHODOPSN) |
| | IPR000276 (7tm 1) |
| | IPR000276 (G PROTEIN RECEP F12) |
| | IPR000276 (G PROTEIN RECEP F11) |
| hP13-026 (SEQ ID NO: 147) | HUMAN PANTHER CLASSIFICATIONS FAMILY (SUBFAMILY) |
| | TRANSFORMING GROWTH FACTOR SUPERFAMILY MEMBER |
| | HUMAN GENE ONTOLOGY |
| | PROCESS |
| | oocyte construction > axis determination |
| | transmembrane receptor protein serine/threonine kinase signaling pathway > TGFbeta receptor signaling pathway |
| | cell communication > cell-cell signaling |
| | GO biological process > developmental processes |
| | skeletal development > ossification |
| | FUNCTION |
| | ligand binding or carrier > protein binding |
| | LOCATION |
| | GO cellular component > extracellular |
| | HUMAN PROTEIN DOMAINS (INTERPRO SIGNATURES) |
| | IPR003942 (TGFBETA4) |
| | IPR001839 (TGFB) |
| | IPR001111 (TGFb propeptide) |
| | IPR001839 (TGF-beta) |
| | IPR001839 (TGF BETA 2) |
| | IPR001839 (TGF BETA) |
| | IPR001839 (sp O00292 TGF4 HUMAN) |
| hP13-028.1 (SEQ ID NO: 153) | HUMAN PANTHER CLASSIFICATIONS FAMILY (SUBFAMILY) |
| | HEMATOPOIETIC PROGENITOR CELL ANTIGEN CD34 HUMAN GENE ONTOLOGY |
| | PROCESS |
| | defence response > humoral defense mechanism |
| | FUNCTION |
| | molecular_function unknown > lymphocyte antigen |
| | LOCATION |
| | cell > plasma membrane |
| | HUMAN PROTEIN DOMAINS (INTERPRO SIGNATURES) |
| | NULL (THR RICH) |
| hP13-028.2 (SEQ ID NO: 155) | HUMAN PANTHER CLASSIFICATIONS FAMILY (SUBFAMILY) |
| | HEMATOPOIETIC PROGENITOR CELL ANTIGEN CD34 HUMAN GENE ONTOLOGY |
| | PROCESS |
| | defence response > humoral defense mechanism |
| | FUNCTION |
| | molecular_function unknown > lymphocyte antigen |
| | LOCATION |
| | cell > plasma membrane |
| | HUMAN PROTEIN DOMAINS (INTERPRO SIGNATURES) |
| | NULL (THR RICH) |
| hP13-028.3 (SEQ ID NO: 157) | HUMAN PANTHER CLASSIFICATIONS FAMILY (SUBFAMILY) |
| | HEMATOPOIETIC PROGENITOR CELL ANTIGEN CD34 HUMAN GENE ONTOLOGY |
| | PROCESS |
| | defence response > humoral defense mechanism |
| | FUNCTION |
| | molecular_function unknown > lymphocyte antigen |

TABLE 29-continued

| HUMAN PROTEIN | CLASSIFICATION |
|---|---|
| | LOCATION<br>cell > plasma membrane<br>HUMAN PROTEIN DOMAINS (INTERPRO SIGNATURES)<br>NULL (THR RICH)<br>IPR001472 (NLS BP) |
| hP13-028.4<br>(SEQ ID NO: 159) | HUMAN PANTHER CLASSIFICATIONS<br>FAMILY (SUBFAMILY)<br>HEMATOPOIETIC PROGENITOR CELL<br>ANTIGEN CD34HUMAN GENE ONTOLOGY<br>PROCESS<br>defence response > humoral defense mechanism<br>FUNCTION<br>molecular_function unknown > lymphocyte<br>antigen<br>LOCATION<br>cell > plasma membrane<br>HUMAN PROTEIN DOMAINS (INTERPRO SIGNATURES)<br>NULL (THR RICH) |
| hP13-036<br>(SEQ ID NO: 165) | HUMAN PANTHER CLASSIFICATIONS<br>FAMILY (SUBFAMILY)<br>CELL ADHESION MOLECULE-<br>RELATEDHUMAN GENE ONTOLOGY<br>PROCESS<br>cell communication > cell adhesion<br>ectoderm development > neurogenesis<br>protein modification > protein dephosphorylation<br>protein modification > protein phosphorylation<br>FUNCTION<br>ligand binding or carrier > calcium binding<br>GO molecular function > cell adhesion<br>B cell receptor<br>defense/immunity protein > immunoglobulin<br>enzyme > protein kinase<br>protein kinase > protein tyrosine kinase<br>LOCATION<br>plasma membrane > integral plasma membrane<br>protein<br>cell > plasma membrane<br>cell > membrane fraction<br>extracellular > extracellular matrix<br>extracellular matrix > basement membrane<br>HUMAN PROTEIN DOMAINS (INTERPRO SIGNATURES)<br>IPR003596 (IGv)<br>IPR000561 (EGF 2)<br>IPR001881 (EGF CA)<br>IPR001261 (ARGE DAPE CPG21)<br>IPR001687 (ATP GTP A)<br>IPR001881 (EGF CA)<br>IPR003598 (IGc2)<br>IPR000561 (EGF)<br>IPR003599 (IG)<br>IPR000561 (EGF)<br>IPR003006 (ig)<br>IPR001881 (EGF CA 26)<br>IPR000152 (ASX HYDROXYL) |
| hP13-060.1<br>(SEQ ID NO: 171) | HUMAN PANTHER CLASSIFICATIONS<br>FAMILY (SUBFAMILY)<br>TRANSFORMING GROWTH FACTOR BETA-<br>RELATED (BONE MORPHOGENETIC PROTEIN 7)<br>MOLECULAR FUNCTIONS<br>Signaling molecule > Cytokine > Other cytokine<br>BIOLOGICAL PROCESS<br>Signal transduction > Cell surface receptor<br>mediated signal transduction > Receptor protein<br>serine/threonine kinase signaling pathway<br>HUMAN GENE ONTOLOGY<br>PROCESS<br>skeletal development > ossification<br>mesoderm development > skeletal development<br>transmembrane receptor protein serine/threonine<br>kinase signaling pathway > TGFbeta receptor signaling pathway<br>cell communication > cell-cell signaling<br>gametogenesis > spermatogenesis<br>FUNCTION<br>ligand binding or carrier > protein binding<br>GO molecular function > cell cycle regulator |

TABLE 29-continued

| HUMAN PROTEIN | CLASSIFICATION |
|---|---|
| | metalloendopeptidase > astacin |
| | enzyme > arginine decarboxylase |
| | LOCATION |
| | GO cellular component > extracellular |
| | extracellular > extracellular space |
| | cell > membrane fraction |
| | HUMAN PROTEIN DOMAINS (INTERPRO SIGNATURES) |
| | IPR001839 (TGFB) |
| | IPR001111 (TGFb propeptide) |
| | IPR001839 (TGF-beta) |
| | IPR001839 (TGF BETA 2) |
| | IPR001839 (TGF BETA) |
| | IPR001839 (sp P18075 BMP7 HUMAN) |
| hP13-060.2 (SEQ ID NO: 173) | HUMAN PANTHER CLASSIFICATIONS |
| | FAMILY (SUBFAMILY) |
| | TRANSFORMING GROWTH FACTOR BETA-RELATED (BONE MORPHOGENETIC PROTEIN 7) |
| | MOLECULAR FUNCTIONS |
| | Signaling molecule > Cytokine > Other cytokine |
| | BIOLOGICAL PROCESS |
| | Signal transduction > Cell surface receptor |
| | mediated signal transduction > Receptor protein |
| | serine/threonine kinase signaling pathway |
| | HUMAN GENE ONTOLOGY |
| | PROCESS |
| | skeletal development > ossification |
| | mesoderm development > skeletal development |
| | transmembrane receptor protein serine/threonine |
| | kinase signaling pathway > TGFbeta receptor signaling pathway |
| | cell communication > cell-cell signaling |
| | gametogenesis > spermatogenesis |
| | FUNCTION |
| | ligand binding or carrier > protein binding |
| | GO molecular function > cell cycle regulator |
| | metalloendopeptidase > astacin |
| | LOCATION |
| | GO cellular component > extracellular |
| | extracellular > extracellular space |
| | cell > membrane fraction |
| | HUMAN PROTEIN DOMAINS (INTERPRO SIGNATURES) |
| | IPR001839 (TGFB) |
| | IPR001111 (TGFb propeptide) |
| | IPR001839 (TGF-beta) |
| | IPR001839 (TGF BETA 2) |
| | IPR001839 (TGF BETA) |
| | IPR001839 (sp P23359 BMP7 MOUSE) |
| hP13-060.3 (SEQ ID NO: 175) | HUMAN PANTHER CLASSIFICATIONS |
| | FAMILY (SUBFAMILY) |
| | TRANSFORMING GROWTH FACTOR BETA-RELATED(BONE MORPHOGENETIC PROTEIN 7) |
| | MOLECULAR FUNCTIONS |
| | Signaling molecule > Cytokine > Other cytokine |
| | BIOLOGICAL PROCESS |
| | Signal transduction > Cell surface receptor |
| | mediated signal transduction > Receptor protein |
| | serine/threonine kinase signaling pathway |
| | HUMAN GENE ONTOLOGY |
| | PROCESS |
| | skeletal development > ossification |
| | mesoderm development > skeletal development |
| | transmembrane receptor protein serine/threonine |
| | kinase signaling pathway > TGFbeta receptor signaling pathway |
| | cell communication > cell-cell signaling |
| | gametogenesis > spermatogenesis |
| | FUNCTION |
| | ligand binding or carrier > protein binding |
| | GO molecular function > cell cycle regulator |
| | metalloendopeptidase > astacin |
| | enzyme > arginine decarboxylase |
| | LOCATION |
| | GO cellular component > extracellular |
| | extracellular > extracellular space |
| | cell > membrane fraction |
| | HUMAN PROTEIN DOMAINS (INTERPRO SIGNATURES) |
| | IPR001839 (TGFB) |
| | IPR001111 (TGFb propeptide) |

TABLE 29-continued

| HUMAN PROTEIN | CLASSIFICATION |
|---|---|
| | IPR001839 (TGF-beta) |
| | IPR001839 (TGF BETA 2) |
| | IPR001839 (TGF BETA) |
| | IPR001839 (sp P18075 BMP7 HUMAN) |
| hP13-065.1 (SEQ ID NO: 181) | HUMAN PANTHER CLASSIFICATIONS FAMILY (SUBFAMILY) GLUTAMATE RECEPTOR-RELATED (GLUTAMATE RECEPTOR 1) MOLECULAR FUNCTIONS Receptor Ion channel > Ligand-gated ion channel > Glutamate receptor BIOLOGICAL PROCESS Signal transduction > Intracellular signaling cascade > Calcium mediated signaling Transport > Ion transport > Cation transport Neuronal activities > Synaptic transmission > Nerve-nerve synaptic transmission HUMAN GENE ONTOLOGY PROCESS G protein linked receptor protein signaling pathway > glutamate signaling pathway cell-cell signaling > synaptic transmission cell growth and maintenance > transport cytoplasm organization and biogenesis > ribosome biogenesis transport > ion transport FUNCTION GO molecular function > enzyme LOCATION cell > membrane fraction cell > plasma membrane plasma membrane > integral plasma membrane protein cytoplasm > synaptic vesicle HUMAN PROTEIN DOMAINS (INTERPRO SIGNATURES) IPR001508 (NMDARECEPTOR) IPR001320 (PBPe) IPR001828 (ANF receptor) IPR001320 (lig chan) IPR001311 (SBP GLUR) IPR001622 (CHANNEL PORE K) |
| hP13-065.2 (SEQ ID NO: 183) | HUMAN PANTHER CLASSIFICATIONS FAMILY (SUBFAMILY) GLUTAMATE RECEPTOR-RELATED (GLUTAMATE RECEPTOR 1) MOLECULAR FUNCTIONS Receptor Ion channel > Ligand-gated ion channel > Glutamate receptor BIOLOGICAL PROCESS Signal transduction > Intracellular signaling cascade > Calcium mediated signaling Transport > Ion transport > Cation transport Neuronal activities > Synaptic transmission > Nerve-nerve synaptic transmission HUMAN GENE ONTOLOGY PROCESS G protein linked receptor protein signaling pathway > glutamate signaling pathway cell-cell signaling > synaptic transmission cell growth and maintenance > transport cytoplasm organization and biogenesis > ribosome biogenesis transport > ion transport FUNCTION GO molecular function > enzyme LOCATION cell > membrane fraction cell > plasma membrane plasma membrane > integral plasma membrane protein cytoplasm > synaptic vesicle HUMAN PROTEIN DOMAINS (INTERPRO SIGNATURES) IPR001508 (NMDARECEPTOR) IPR001320 (PBPe) |

TABLE 29-continued

| HUMAN PROTEIN | CLASSIFICATION |
|---|---|
| | IPR001828 (ANF receptor) |
| | IPR001320 (lig chan) |
| | IPR001311 (SBP GLUR) |
| | IPR001622 (CHANNEL PORE K) |
| hP13-065.3 (SEQ ID NO: 185) | HUMAN PANTHER CLASSIFICATIONS FAMILY (SUBFAMILY) GLUTAMATE RECEPTOR-RELATED(GLUTAMATE RECEPTOR 1) MOLECULAR FUNCTIONS Receptor Ion channel > Ligand-gated ion channel > Glutamate receptor BIOLOGICAL PROCESS Signal transduction > Intracellular signaling cascade > Calcium mediated signaling Transport > Ion transport > Cation transport Neuronal activities > Synaptic transmission > Nerve-nerve synaptic transmission HUMAN GENE ONTOLOGY PROCESS G protein linked receptor protein signaling pathway > glutamate signaling pathway cell-cell signaling > synaptic transmission cell growth and maintenance > transport cytoplasm organization and biogenesis > ribosome biogenesis transport > ion transport FUNCTION GO molecular function > enzyme LOCATION cell > membrane fraction cell > plasma membrane plasma membrane > integral plasma membrane protein cytoplasm > synaptic vesicle HUMAN PROTEIN DOMAINS (INTERPRO SIGNATURES) IPR001508 (NMDARECEPTOR) IPR001320 (PBPe) IPR001828 (ANF receptor) IPR001320 (lig chan) IPR001311 (SBP GLUR) IPR001622 (CHANNEL PORE K) |
| hP14-032 (SEQ ID NO: 191) | HUMAN PANTHER CLASSIFICATIONS FAMILY (SUBFAMILY) CARCINOEMBRYONIC ANTIGEN(CARCINOEMBRYONIC ANTIGEN) MOLECULAR FUNCTIONS Cell adhesion molecule > CAM family adhesion molecule BIOLOGICAL PROCESS Biological process unclassified HUMAN GENE ONTOLOGY PROCESS defence response > immune response protein-membrane targeting > post-translational membrane targeting cell communication > cell adhesion cell communication > signal transduction cell communication > cell-cell signaling FUNCTION molecular_function unknown > tumor antigen B cell receptor defense/immunity protein > immunoglobulin GO molecular function > cell adhesion protein kinase > protein tyrosine kinase calmodulin regulated protein kinase > myosin light chain kinase LOCATION extracellular > extracellular space plasma membrane > integral plasma membrane protein cell > membrane fraction cell > plasma membrane plasma membrane > peripheral plasma membrane protein |

TABLE 29-continued

| HUMAN PROTEIN | CLASSIFICATION |
|---|---|
| | HUMAN PROTEIN DOMAINS (INTERPRO SIGNATURES) |
| | IPR003598 (IGc2) |
| | IPR003599 (IG) |
| | IPR003006 (ig) |
| hP14-033 | HUMAN PANTHER CLASSIFICATIONS |
| (SEQ ID NO: 197) | FAMILY (SUBFAMILY) |
| | BETA-AMYLOID) PRECURSOR PROTEIN- |
| | RELATED(ALZHEIMER'S DISEASE AMYLOID A4 |
| | PROTEIN-RELATED) |
| | MOLECULAR FUNCTIONS |
| | Receptor > Other receptor |
| | BIOLOGICAL PROCESS |
| | Signal transduction > Cell communication > Ligand- |
| | mediated signaling |
| | Signal transduction > Cell surface receptor |
| | mediated signal transduction > G-protein mediated signaling |
| | Neuronal activities > Synaptic transmission > Neurotransmitter |
| | release |
| | Apoptosis > Induction of apoptosis |
| | Cell structure and motility > Cell structure |
| | HUMAN GENE ONTOLOGY |
| | PROCESS |
| | metal ion homeostasis > copper homeostasis |
| | cell death > apoptosis |
| | cell communication > signal transduction |
| | mating (sensu Saccharomyces) > pheromone |
| | response |
| | cell growth and maintenance > cell death |
| | FUNCTION |
| | proteinase inhibitor > serine protease inhibitor |
| | nucleic acid binding > DNA binding |
| | enzyme inhibitor > proteinase inhibitor |
| | GO molecular function > cell adhesion |
| | GO molecular function > ligand binding or carrier |
| | LOCATION |
| | cell > membrane fraction |
| | cytoplasm > Golgi apparatus |
| | extracellular > extracellular space |
| | cytoplasm > endoplasmic reticulum |
| | GO cellular component > extracellular |
| | HUMAN PROTETN DOMAINS (INTERPRO SIGNATURES) |
| | IPR002223 (BASIC PTASE) |
| | IPR001868 (A4 INTRA) |
| | IPR001868 (A4 EXTRA) |
| | IPR002223 (BPTI KUNITZ 1) |
| | IPR001868 (AMYLOIDA4) |
| | IPR001255 (BETAAMYLOID) |
| | IPR002223 (KU) |
| | IPR001868 (A4 EXTRA) |
| | IPR001868 (A4 EXTRA) |
| | IPR002223 (Kunitz BPTI) |
| | NULL (GLU RICH) |
| | IPR002223 (BPTI KUNITZ 2) |

A CA protein (CAP) is a calcium binding protein wherein the CAP sequence is SEQ ID NOS: 6, 34, 113 and 165.

A CA protein (CAP) is a G-protein coupled receptor antagonist wherein the CAP sequence is SEQ ID NOS: 141, 181, 197.

A CA protein (CAP) is a tyrosine phosphatase wherein the CAP sequence is selected from the group consisting of SEQ ID NOS: 119 and 121.

A CA protein (CAP) is an amino acid transport protein wherein the CAP sequence is selected from the group consisting of SEQ ID NOS: 58, 60 and 62.

A CA protein (CAP) is an apoptosis-related protein wherein the CAP sequence is selected from the group consisting of SEQ ID NOS: 18, 20, 22 and 28.

A CA protein (CAP) is involved in signalling wherein the CAP sequence is selected from the group consisting of SEQ ID NOS: 34, 40, 79, 119, 121, 127, 141, 147, 171, 173, 175, 181, 183, 185, 191 and 197.

A CA protein (CAP) is a cell adhesion molecule wherein the CAP sequence is selected from the group consisting of SEQ ID NOS: 12, 52, 76, 85, 87, 89, 95, 101, 107, 113, 135 and 165.

A CA protein (CAP) is a tyrosine kinase wherein the CAP sequence is selected from the group consisting of SEQ ID NOS: 165 and 191.

A CA protein (CAP) is expressed on a cell surface, wherein the CA protein is selected from the group consisting of SEQ ID NOS: 6, 12, 18, 20, 22, 28, 34, 40, 52, 58, 60, 62, 68, 70, 76, 79, 85, 87, 89, 95, 101, 107, 113, 119, 121, 127, 135, 141, 147, 153, 155, 157, 159, 165, 171, 173, 175, 181, 183, 185, 191, 197 and 203.

Certain aspects of the present invention are described in greater detail in the non-limiting examples that follow.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all and only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric.

Example 1

Insertion Site Analysis Following Tumor Induction in Mice

Tumors are induced in mice using either mouse mammary tumor virus (MMTV) or murine leukemia virus (MLV). MMTV causes mammary adenocarcinomas and MLV causes a variety of different hematopoetic malignancies (primarily T- or B-cell lymphomas). Three routes of infection are used: (1) injection of neonates with purified virus preparations, (2) infection by milk-borne virus during nursing, and (3) genetic transmission of pathogenic proviruses via the germ-line (Akvr1 and/or Mtv2). The type of malignancy present in each affected mouse is determined by histological analysis of H&E-stained thin sections of formalin-fixed, paraffin-embedded biopsy samples. Host DNA sequences flanking all clonally-integrated proviruses in each tumor are recovered by nested anchored-PCR using two virus-specific primers and two primers specific for a 40 bp double stranded DNA anchor ligated to restriction enzyme digested tumor DNA. Amplified bands representing host/virus junction fragments are cloned and sequenced. Then the host sequences (called "tags") are used to BLAST analyze the Celera mouse genomic sequence. For each individual tag, three parameters are recorded: (1) the mouse chromosome assignment, (2) base pair coordinates at which the integration occurred, and (3) provirus orientation. Using this information, all available tags from all analyzed tumors are mapped to the mouse genome. To identify the protooncogene targets of provirus insertion mutation, the provirus integration pattern at each cluster of integrants is analyzed relative to the locations of all known genes in the transcriptome. The presence of provirus at the same locus in two or more independent tumors is prima facie evidence that a protooncogene is present at or very near the proviral integration sites. This is because the genome is too large for random integrations to result in observable clustering. Any clustering that is detected is unequivocal evidence for biological selection during tumorigenesis. In order to identify the human orthologs of the protooncogene targets of provirus insertion mutation, a comparative analysis of syntenic regions of the mouse and human genomes is performed.

An example of PCR amplification of host/virus junction fragments is presented in FIG. 1. Lane 1 contains the amplification products from normal control DNA and lane 2 contains the amplification products from tumor DNA. The bands result from 5' host/virus junction fragments present in the DNA samples. Lane 1 has bands from the env/3' LTR junctions from all proviruses (upper) and the host/5' LTR from the pathogenic endogenous Mtv2 provirus present in this particular mouse strain. This endogenous provirus is detected because its sequence is identical to the new clonally integrated proviruses in the tumor. All four new clonally integrated proviruses known to be in this tumor are readily detected.

Example 2

Analysis of Quantitative RT-PCR: Comparative $C_T$ Method

The expression level of target genes is quantified using the ABI PRISM 7900HT Sequence Detection System (Applied Biosystems, California). The method is based on the quantitation of the initial copy number of target template in comparison to that of a reference (normalizer) housekeeper gene (Pre-Developed TaqMan® Assay Reagents Gene Expression Quantification Protocol, Applied Biosystems, 2001). Accumulation of DNA product with each PCR cycle is related to amplicon efficiency and the initial template concentration. Therefore the amplification efficiency of both the target and the normalizer must be approximately equal. The threshold cycle ($C_T$), which is dependent on the starting template copy number and the DNA amplification efficiency, is a PCR cycle during which PCR product growth is exponential. With a similar dynamic range for the target and normalizer, the comparative $C_T$ method is applicable.

An example of the comparative $C_T$ method of gene expression for quantitative RT-PCR is shown in FIG. 2. In the first step, assays are performed in quadruplicate on a normal tissue and several sample tissues. In these tissues, the means and standard deviations of $C_T$ values are determined for housekeeper genes (chosen as controls if shown to be biologically stable among various samples, irrespective of disease state) and for the target gene. FIG. 2 shows an example of average $C_T$ values for a housekeeper gene and target gene. These values can fall within a range from upper teens to 40 depending on the intrinsic expression level of the gene in the particular tissue. The coefficient of variance of all replicate sets cannot exceed 1.5%.

An assessment of how the ACT changes with template dilution verifies that the efficiencies of the target and housekeeper amplicons are approximately equal if the log input amount of template RNA versus $\Delta C_T$ plot has a slope <0.10. With the relative efficiencies verified for target and housekeeper, the $\Delta \Delta C_T$ comparative calculation becomes valid, as mentioned above. An example of the calculated difference between the $C_T$ values of target and housekeeper genes ($\Delta C_T$) for various samples is shown in FIG. 3. The $\Delta \Delta C_T$ is calculated for each sample by subtracting its $\Delta C_T$ value from the $\Delta C_T$ value of the baseline (calibrator) sample. If the expression is increased in some samples and decreased in others, $\Delta \Delta C_T$ will be a mixture of negative and positive values. The final step in the calculation is to transform these values to absolute values. The formula for this is:

Comparative expression level=$2^{-\Delta \Delta C_T}$

The final value for the calibrator should always be one. FIG. 4 shows the $\Delta \Delta C_T$ and comparative expression level for each sample from FIG. 3.

Example 3

Detection of Elevated Levels of cDNA Associated with Cancer Using Arrays cDNA sequences representing a variety of candidate CA genes to be screened for differential expression in cancer are assayed by hybridization on polynucleotide arrays. The cDNA sequences include cDNA clones isolated from cell lines or tissues of interest. The cDNA sequences analyzed also include polynucleotides comprising sequence overlap with sequences in the Unigene database, and which encode a variety of gene products of various origins, functionality, and levels of characterization. cDNAs are spotted onto reflective slides (Amersham) according to methods well known in the art at a density of 9,216 spots per slide representing 4,068 sequences (including controls) spotted in duplicate, with approximately 0.8 µl of an approximately 200 ng/µl solution of cDNA.

PCR products of selected cDNA clones corresponding to the gene products of interest are prepared in a 50% DMSO solution. These PCR products are spotted onto Amersham aluminum microarray slides at a density of 9216 clones per array using a Molecular Dynamics Generation III spotting robot. Clones are spotted in duplicate, for a total of 4608 different sequences per chip.

cDNA probes are prepared from total RNA obtained by laser capture microdissection (LCM, Arcturus Engineering Inc., Mountain View, Calif.) of tumor tissue samples and normal tissue samples isolated from patients.

Total RNA is first reverse transcribed into cDNA using a primer containing a T7 RNA polymerase promoter, followed by second strand DNA synthesis. cDNA is then transcribed in vitro to produce antisense RNA using the T7 promoter-mediated expression (see, e.g., Luo et al. (1999) *Nature Med* 5:117-122), and the antisense RNA is then converted into cDNA. The second set of cDNAs are again transcribed in vitro, using the T7 promoter, to provide antisense RNA. This antisense RNA is then fluorescently labeled, or the RNA is again converted into cDNA, allowing for a third round of T7-mediated amplification to produce more antisense RNA. Thus the procedure provides for two or three rounds of in vitro transcription to produce the final RNA used for fluorescent labeling. Probes are labeled by making fluorescently labeled cDNA from the RNA starting material. Fluorescently labeled cDNAs prepared from the tumor RNA sample are compared to fluorescently labeled cDNAs prepared from normal cell RNA sample. For example, the cDNA probes from the normal cells are labeled with Cy3 fluorescent dye (green) and the cDNA probes prepared from suspected cancer cells are labeled with Cy5 fluorescent dye (red).

The differential expression assay is performed by mixing equal amounts of probes from tumor cells and normal cells of the same patient. The arrays are prehybridized by incubation for about 2 hrs at 60° C. in 5×SSC, 0.2% SDS, 1 mM EDTA, and then washing three times in water and twice in isopropanol. Following prehybridization of the array, the probe mixture is then hybridized to the array under conditions of high stringency (overnight at 42° C. in 50% formamide, 5×SSC, and 0.2% SDS. After hybridization, the array is washed at 55° C. three times as follows: 1) first wash in 1×SSC/0.2% SDS; 2) second wash in 0.1×SSC/0.2% SDS; and 3) third wash in 0.1×SSC.

The arrays are then scanned for green and red fluorescence using a Molecular Dynamics Generation III dual color laser-scanner/detector. The images are processed using BioDiscovery Autogene software, and the data from each scan set normalized. The experiment is repeated, this time labeling the two probes with the opposite color in order to perform the assay in both "color directions." Each experiment is sometimes repeated with two more slides (one in each color direction). The data from each scan is normalized, and the level of fluorescence for each sequence on the array expressed as a ratio of the geometric mean of 8 replicate spots/genes from the four arrays or 4 replicate spots/gene from 2 arrays or some other permutation.

Normalization: The objective of normalization is to generate a cDNA library in which all transcripts expressed in a particular cell type or tissue are equally represented (S. M. Weissman, Mol Biol. Med. 4(3):133-143 (1987); Patanjali, et al., Proc. Natl. Acad. Sci. USA 88(5):1943-1947 (1991)), and therefore isolation of as few as 30,000 recombinant clones in an optimally normalized library may represent the entire gene expression repertoire of a cell, estimated to number 10,000 per cell.

Total RNA is extracted from harvested cells using RNeasy™ Protect Kit (Qiagen, Valencia, Calif.), following manufacturer's recommended procedures. RNA is quantified using RiboGreen™ RNA quantification kit (Molecular Probes, Inc. Eugene, Oreg.). One µg of total RNA is reverse transcribed and PCR amplified using SMART™ PCR cDNA synthesis kit (ClonTech, Palo Alto, Calif.). The cDNA products are size-selected by agarose gel electrophoresis using standard procedures (Sambrook, J. T., et al. Molecular Cloning: A Laboratory Manual, 2d ed., Cold Spring Harbor Laboratory Press, NY). The cDNA is extracted using Bio 101 Geneclean® II kit (Qbiogene, Carlsbad, Calif.). Normalization of the cDNA is carried out using kinetics of hybridization principles: 1.0 µg of cDNA is denatured by heat at 100° C. for 10 minutes, then incubated at 42° C. for 42 hours in the presence of 120 mM NaCl, 10 mM Tris.HCl (pH=8.0), 5 mM EDTA.Na+ and 50% formamide. Single-stranded cDNA ("normalized") is purified by hydroxyapatite chromatography (#130-0520, BioRad, Hercules, Calif.) following the manufacturer's recommended procedures, amplified and converted to double-stranded cDNA by three cycles of PCR amplification, and cloned into plasmid vectors using standard procedures (Sambrook, J. T., et al. Molecular Cloning: A Laboratory Manual, 2d ed., Cold Spring Harbor Laboratory Press, NY). All primers/adaptors used in the normalization and cloning process are provided by the manufacturer in the SMART™ PCR cDNA synthesis kit (ClonTech, Palo Alto, Calif.). Supercompetent cells (XL-2 Blue Ultracompetent Cells, Stratagene, Calif.) are transfected with the normalized cDNA libraries, plated on solid media and grown overnight at 36° C.

The sequences of 10,000 recombinants per normalized library are analyzed by capillary sequencing using the ABI PRISM 3700 DNA Analyzer (Applied Biosystems, California). To determine the representation of transcripts in a library, BLAST analysis is performed on the clone sequences to assign transcript identity to each isolated clone, i.e., the sequences of the isolated polynucleotides are first masked to eliminate low complexity sequences using the XBLAST masking program (Claverie "Effective Large-Scale Sequence Similarity Searches," *Computer Methods for Macromolecular Sequence Analysis*, Doolittle, ed., *Meth. Enzymol.* 266: 212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. The remaining sequences are then used in a BLASTN vs. GenBank search. The sequences are also used as query sequence in a BLASTX vs. NRP (non-redundant proteins) database search.

Automated sequencing reactions are performed using a Perkin-Elmer PRISM Dye Terminator Cycle Sequencing Ready Reaction Kit containing AmpliTaq DNA Polymerase, FS, according to the manufacturer's directions. The reactions are cycled on a GeneAmp PCR System 9600 as per manufacturer's instructions, except that they are annealed at 20° C. or 30° C. for one minute. Sequencing reactions are ethanol precipitated, pellets are resuspended in 8 microliters of loading buffer, 1.5 microliters is loaded on a sequencing gel, and the data is collected by an ABI PRISM 3700 DNA Sequencer. (Applied Biosystems, Foster City, Calif.).

The number of times a sequence is represented in a library is determined by performing sequence identity analysis on the cloned cDNA sequences and assigning transcript identity to each isolated clone. First, each sequence is checked to determine if it is a bacterial, ribosomal, or mitochondrial contaminant. Such sequences are excluded from the subsequent analysis. Second, sequence artifacts, such as vector and repetitive elements, are masked and/or removed from each sequence.

The remaining sequences are compared via BLAST (Altschul et. al, J. Mol. Biol., 215:40, 1990) to GenBank and EST databases for gene identification and are compared with each other via FastA (Pearson & Lipman, PNAS, 85:2444, 1988) to calculate the frequency of cDNA appearance in the normalized cDNA library. The sequences are also searched against the GenBank and GeneSeq nucleotide databases using the BLASTN program (BLASTN 1.3MP: Altschul et al., J. Mol. Bio. 215:403, 1990). Fourth, the sequences are analyzed against a non-redundant protein (NRP) database with the BLASTX program (BLASTX 1.3MP: Altschul et al., supra). This protein database is a combination of the Swiss-Prot, PIR, and NCBI GenPept protein databases. The BLASTX program is run using the default BLOSUM-62 substitution matrix with the filter parameter: "xnu+seg". The score cutoff utilized is 75. Assembly of overlapping clones into contigs is done using the program Sequencher (Gene Codes Corp.; Ann Arbor, Mich.). The assembled contigs are analyzed using the programs in the GCG package (Genetic Computer Group, University Research Park, 575 Science Drive, Madison, Wis. 53711) Suite Version 10.1.

Example 4

Detection of CA-Sequences in Human Cancer Cells and Tissues

DNA from prostate and breast cancer tissues and other human cancer tissues, human colon, normal human tissues including non-cancerous prostate, and from other human cell lines are extracted following the procedure of Delli Bovi et al. (1986, Cancer Res. 46:6333-6338). The DNA is resuspended in a solution containing 0.05 M Tris HCl buffer, pH 7.8, and 0.1 mM EDTA, and the amount of DNA recovered is determined by microfluorometry using Hoechst 33258 dye. Cesarone, C. et al., Anal Biochem 100:188-197 (1979).

Polymerase chain reaction (PCR) is performed using Taq polymerase following the conditions recommended by the manufacturer (Perkin Elmer Cetus) with regard to buffer, $Mg^{2+}$, and nucleotide concentrations. Thermocycling is performed in a DNA cycler by denaturation at 94° C. for 3 min. followed by either 35 or 50 cycles of 94° C. for 1.5 min., 50° C. for 2 min. and 72° C. for 3 min. The ability of the PCR to amplify the selected regions of the CA gene is tested by using a cloned CA polynucleotide(s) as a positive template(s). Optimal $Mg^{2+}$, primer concentrations and requirements for the different cycling temperatures are determined with these templates. The master mix recommended by the manufacturer is used. To detect possible contamination of the master mix components, reactions without template are routinely tested.

Southern blotting and hybridization are performed as described by Southern, E. M., (J. Mol. Biol. 98:503-517, 1975), using the cloned sequences labeled by the random primer procedure (Feinberg, A. P., et al., 1983, Anal. Biochem. 132:6-13). Prehybridization and hybridization are performed in a solution containing 6×SSPE, 5% Denhardt's, 0.5% SDS, 50% formamide, 100 μg/ml denatured salmon testis DNA, incubated for 18 hrs at 42° C., followed by washings with 2×SSC and 0.5% SDS at room temperature and at 37° C. and finally in 0.1×SSC with 0.5% SDS at 68° C. for 30 min (Sambrook et al., 1989, in "Molecular Cloning: A Laboratory Manual", Cold Spring Harbor Lab. Press). For paraffin-embedded tissue sections the conditions described by Wright and Manos (1990, in "PCR Protocols", Innis et al., eds., Academic Press, pp. 153-158) are followed using primers designed to detect a 250 bp sequence.

Example 5

Detection of CA Sequences in Human Cancer Cells and Tissues

DNA from human cancer tissues, normal human tissues and from other human cell lines is extracted following the procedure of Delli Bovi et al. (1986, Cancer Res. 46:6333-6338). The DNA is resuspended in a solution containing 0.05 M Tris HCl buffer, pH 7.8, and 0.1 mM EDTA, and the amount of DNA recovered is determined by microfluorometry using Hoechst 33258 dye. Cesarone, C. et al., Anal Biochem 100:188-197 (1979).

Polymerase chain reaction (PCR) is performed using Taq polymerase following the conditions recommended by the manufacturer (Perkin Elmer Cetus) with regard to buffer, $Mg^{2+}$, and nucleotide concentrations. Thermocycling is performed in a DNA cycler by denaturation at 94° C. for 3 min. followed by either 35 or 50 cycles of 94° C. for 1.5 min., 50° C. for 2 min. and 72° C. for 3 min. The ability of the PCR to amplify the selected regions of CA genes is tested by using a cloned CA polynucleotide(s) as a positive template(s). Optimal $Mg^{2+}$, primer concentrations and requirements for the different cycling temperatures are determined with these templates. The master mix recommended by the manufacturer is used. To detect possible contamination of the master mix components, reactions without template are routinely tested.

Southern blotting and hybridization are performed as described by Southern, E. M., (J. Mol. Biol. 98:503-517, 1975), using the cloned sequences labeled by the random primer procedure (Feinberg, A. P., et al., 1983, Anal. Biochem. 132:6-13). Prehybridization and hybridization are performed in a solution containing 6×SSPE, 5% Denhardt's, 0.5% SDS, 50% formamide, 100 μg/ml denatured salmon testis DNA, incubated for 18 hrs at 42° C., followed by washings with 2×SSC and 0.5% SDS at room temperature and at 37° C. and finally in 0.1×SSC with 0.5% SDS at 68° C. for 30 min (Sambrook et al., 1989, in "Molecular Cloning: A Laboratory Manual", Cold Spring Harbor Lab. Press). For paraffin-embedded tissue sections the conditions described by Wright and Manos (1990, in "PCR Protocols", Innis et al., eds., Academic Press, pp. 153-158) are followed using primers designed to detect a 250 bp sequence.

Example 6

Expression of Cloned Polynucleotides in Host Cells

To study the protein products of CA genes, restriction fragments from CA DNA are cloned into the expression vector pMT2 (Sambrook, et al., Molecular Cloning: A Laboratory Manual, Cold Spring Harbor Laboratory Press pp 16.17-16.22 (1989)) and transfected into COS cells grown in DMEM supplemented with 10% FCS. Transfections are performed employing calcium phosphate techniques (Sambrook, et al (1989) pp. 16.32-16.40, supra) and cell lysates are prepared forty-eight hours after transfection from both transfected and untransfected COS cells. Lysates are subjected to analysis by immunoblotting using anti-peptide antibody.

In immunoblotting experiments, preparation of cell lysates and electrophoresis are performed according to standard procedures. Protein concentration is determined using BioRad protein assay solutions. After semi-dry electrophoretic transfer to nitrocellulose, the membranes are blocked in 500 mM NaCl, 20 mM Tris, pH 7.5, 0.05% Tween-20 (TTBS) with 5% dry milk. After washing in TTBS and incubation with secondary antibodies (Amersham), enhanced chemiluminescence (ECL) protocols (Amersham) are performed as described by the manufacturer to facilitate detection.

Example 7

Generation of Antibodies Against Polypeptides

Polypeptides, unique to CA genes are synthesized or isolated from bacterial or other (e.g., yeast, baculovirus) expression systems and conjugated to rabbit serum albumin (RSA) with m-maleimido benzoic acid N-hydroxysuccinimide ester (MBS) (Pierce, Rockford, Ill.). Immunization protocols with these peptides are performed according to standard methods. Initially, a pre-bleed of the rabbits is performed prior to immunization. The first immunization includes Freund's complete adjuvant and 500 µg conjugated peptide or 100 µg purified peptide. All subsequent immunizations, performed four weeks after the previous injection, include Freund's incomplete adjuvant with the same amount of protein. Bleeds are conducted seven to ten days after the immunizations.

For affinity purification of the antibodies, the corresponding CA polypeptide is conjugated to RSA with MBS, and coupled to CNBr-activated Sepharose (Pharmacia, Uppsala, Sweden). Antiserum is diluted 10-fold in 10 mM Tris-HCl, pH 7.5, and incubated overnight with the affinity matrix. After washing, bound antibodies are eluted from the resin with 100 mM glycine, pH 2.5.

Example 8

Generation of Monoclonal Antibodies Against a CA Polypeptide

A non-denaturing adjuvant (Ribi, R730, Corixa, Hamilton Mont.) is rehydrated to 4 ml in phosphate buffered saline. 100 µl of this rehydrated adjuvant is then diluted with 400 µl of Hank's Balanced Salt Solution and this is then gently mixed with the cell pellet used for immunization. Approximately 500 µg conjugated peptide or 100 µg purified peptide and Freund's complete are injected into Balb/c mice via foot-pad, once a week. After 6 weeks of weekly injection, a drop of blood is drawn from the tail of each immunized animal to test the titer of antibodies against CA polypeptides using FACS analysis. When the titer reaches at least 1:2000, the mice are sacrificed in a $CO_2$ chamber followed by cervical dislocation. Lymph nodes are harvested for hybridoma preparation. Lymphocytes from mice with the highest titer are fused with the mouse myeloma line X63-Ag8.653 using 35% polyethylene glycol 4000. On day 10 following the fusion, the hybridoma supernatants are screened for the presence of CAP-specific monoclonal antibodies by fluorescence activated cell sorting (FACS). Conditioned medium from each hybridoma is incubated for 30 minutes with a combined aliquot of PC3, Colo-205, LnCap, or Panc-1 cells. After incubation, the cell samples are washed, resuspended in 0.1 ml diluent and incubated with 1 µg/ml of FITC conjugated F(ab')2 fragment of goat anti-mouse IgG for 30 min at 4° C. The cells are washed, resuspended in 0.5 ml FACS diluent and analyzed using a FACScan cell analyzer (Becton Dickinson; San Jose, Calif.). Hybridoma clones are selected for further expansion, cloning, and characterization based on their binding to the surface of one or more of cell lines which express the CA polypeptide as assessed by FACS. A hybridoma making a monoclonal antibody designated mAbCA which binds an antigen designated Ag-CA.x and an epitope on that antigen designated Ag-CA.x.1 is selected.

Example 9

ELISA Assay for Detecting CA Related Antigens

To test blood samples for antibodies that bind specifically to recombinantly produced CA antigens, the following procedure is employed. After a recombinant CA related protein is purified, the recombinant protein is diluted in PBS to a concentration of 5 µg/ml (500 ng/100 µl). 100 microliters of the diluted antigen solution is added to each well of a 96-well Immulon 1 plate (Dynatech Laboratories, Chantilly, Va.), and the plate is then incubated for 1 hour at room temperature, or overnight at 4° C., and washed 3 times with 0.05% Tween 20 in PBS. Blocking to reduce nonspecific binding of antibodies is accomplished by adding to each well 200 µl of a 1% solution of bovine serum albumin in PBS/Tween 20 and incubation for 1 hour. After aspiration of the blocking solution, 100 µl of the primary antibody solution (anticoagulated whole blood, plasma, or serum), diluted in the range of 1/16 to 1/2048 in blocking solution, is added and incubated for 1 hour at room temperature or overnight at 4° C. The wells are then washed 3 times, and 100 µl of goat anti-human IgG antibody conjugated to horseradish peroxidase (Organon Teknika, Durham, N.C.), diluted 1/500 or 1/1000 in PBS/Tween 20, 100 µl of o-phenylenediamine dihydrochloride (OPD, Sigma) solution is added to each well and incubated for 5-15 minutes. The OPD solution is prepared by dissolving a 5 mg OPD tablet in 50 ml 1% methanol in $H_2O$ and adding 50 µl 30% $H_2O_2$ immediately before use. The reaction is stopped by adding 25 l of 4M $H_2SO_4$. Absorbances are read at 490 nm in a microplate reader (Bio-Rad).

Example 10

Identification and Characterization of CA Antigen on Cancer Cell Surface

A cell pellet of proximately 25 ul packed cell volume of a cancer cell preparation is lysed by first diluting the cells to 0.5 ml in water followed by freezing and thawing three times. The solution is centrifuged at 14,000 rpm. The resulting pellet, containing the cell membrane fragments, is resuspended in 50 µl of SDS sample buffer (Invitrogen, Carlsbad, Calif.). The sample is heated at 80° C. for 5 minutes and then centrifuged for 2 minutes at 14,000 rpm to remove any insoluble materials.

The samples are analyzed by Western blot using a 4 to 20% polyacrylamide gradient gel in Tris-Glycine SDS (Invitrogen; Carlsbad Calif.) following the manufacturer's directions. Ten microliters of membrane sample are applied to one lane on the polyacrylamide gel. A separate 10 µL sample is reduced first by the addition of 2 µL of dithiothreitol (100 mM) with heating at 80° C. for 2 minutes and then loaded into another lane. Pre-stained molecular weight markers SeeBlue Plus2 (Invitrogen; Carlsbad, Calif.) are used to assess molecular weight on the gel. The gel proteins are transferred to a nitrocellulose membrane using a transfer buffer of 14.4 g/l glycine, 3 g/l of Tris Base, 10% methanol, and 0.05% SDS. The membranes are blocked, probed with a CAP-specific monoclonal antibody (at a concentration of 0.5 ug/ml), and developed using the Invitrogen WesternBreeze Chromogenic Kit-AntiMouse according to the manufacturer's directions. In the reduced sample of the tumor cell membrane samples, a prominent band is observed migrating at a molecular weight within about 10% of the predicted molecular weight of the corresponding CA protein.

Example 11

Preparation of Vaccines

The present invention also relates to a method of stimulating an immune response against cells that express CA polypeptides in a patient using CA polypeptides of the invention that act as an antigen produced by or associated with a malignant cell. This aspect of the invention provides a method of stimulating an immune response in a human against cancer cells or cells that express CA polynucleotides and polypeptides. The method comprises the step of administering to a human an immunogenic amount of a polypeptide comprising: (a) the amino acid sequence of a huma CA protein or (b) a mutein or variant of a polypeptide comprising the amino acid sequence of a human endogenous retrovirus CA protein.

Example 12

Generation of Transgenic Animals Expressing Polypeptides as a Means for Testing Therapeutics CA nucleic acids are used to generate genetically modified non-human animals, or site specific gene modifications thereof, in cell lines, for the study of function or regulation of prostate tumor-related genes, or to create animal models of diseases, including prostate cancer. The term "transgenic" is intended to encompass genetically modified animals having an exogenous CA gene(s) that is stably transmitted in the host cells where the gene(s) may be altered in sequence to produce a modified protein, or having an exogenous CA LTR promoter operably linked to a reporter gene. Transgenic animals may be made through a nucleic acid construct randomly integrated into the genome. Vectors for stable integration include plasmids, retroviruses and other animal viruses, YACs, and the like. Of interest are transgenic mammals, e.g. cows, pigs, goats, horses, etc., and particularly rodents, e.g. rats, mice, etc.

The modified cells or animals are useful in the study of CA gene function and regulation. For example, a series of small deletions and/or substitutions may be made in the CA genes to determine the role of different genes in tumorigenesis. Specific constructs of interest include, but are not limited to, antisense constructs to block CA gene expression, expression of dominant negative CA gene-mutations, and over-expression of a CA gene. Expression of a CA gene or variants thereof in cells or tissues where it is not normally expressed or at abnormal times of development is provided. In addition, by providing expression of proteins derived from CA in cells in which it is otherwise not normally produced, changes in cellular behavior can be induced.

DNA constructs for random integration need not include regions of homology to mediate recombination. Conveniently, markers for positive and negative selection are included. For various techniques for transfecting mammalian cells, see Keown et al., Methods in Enzymology 185:527-537 (1990).

For embryonic stem (ES) cells, an ES cell line is employed, or embryonic cells are obtained freshly from a host, e.g. mouse, rat, guinea pig, etc. Such cells are grown on an appropriate fibroblast-feeder layer or grown in the presence of appropriate growth factors, such as leukemia inhibiting factor (LIF). When ES cells are transformed, they may be used to produce transgenic animals. After transformation, the cells are plated onto a feeder layer in an appropriate medium. Cells containing the construct may be detected by employing a selective medium. After sufficient time for colonies to grow, they are picked and analyzed for the occurrence of integration of the construct. Those colonies that are positive may then be used for embryo manipulation and blastocyst injection. Blastocysts are obtained from 4 to 6 week old superovulated females. The ES cells are trypsinized, and the modified cells are injected into the blastocoel of the blastocyst. After injection, the blastocysts are returned to each uterine horn of pseudopregnant females. Females are then allowed to go to term and the resulting chimeric animals screened for cells bearing the construct. By providing for a different phenotype of the blastocyst and the ES cells, chimeric progeny can be readily detected.

The chimeric animals are screened for the presence of the modified gene and males and females having the modification are mated to produce homozygous progeny. If the gene alterations cause lethality at some point in development, tissues or organs are maintained as allogeneic or congenic grafts or transplants, or in in vitro culture. The transgenic animals may be any non-human mammal, such as laboratory animals, domestic animals, etc. The transgenic animals are used in functional studies, drug screening, etc., e.g. to determine the effect of a candidate drug on prostate cancer, to test potential therapeutics or treatment regimens, etc.

Example 13

Diagnostic Imaging using CA Specific Antibodies

The present invention encompasses the use of antibodies to CA polypeptides to accurately stage cancer patients at initial presentation and for early detection of metastatic spread of cancer. Radioimmunoscintigraphy using monoclonal antibodies specific for CA polypeptides can provide an additional cancer-specific diagnostic test. The monoclonal antibodies of the instant invention are used for histopathological diagnosis of carcinomas.

Subcutaneous human xenografts of cancer cells in nude mice is used to test whether a technetium-99m ($^{99m}$Tc)-labeled monoclonal antibody of the invention can successfully image the xenografted cancer by external gamma scintography as described for seminoma cells by Marks, et al., Brit. J.

Urol. 75:225 (1995). Each monoclonal antibody specific for a CA polypeptide is purified from ascitic fluid of BALB/c mice bearing hybridoma tumors by affinity chromatography on protein A-Sepharose. Purified antibodies, including control monoclonal antibodies such as an avidin-specific monoclonal antibody (Skea, et al., J. Immunol. 151:3557 (1993)) are labeled with $^{99m}$Tc following reduction, using the methods of Mather, et al., J. Nucl. Med. 31:692 (1990) and Zhang et al., Nucl. Med. Biol. 19:607 (1992). Nude mice bearing human cancer cells are injected intraperitoneally with 200-500 µCi of $^{99m}$Tc-labeled antibody. Twenty-four hours after injection, images of the mice are obtained using a Siemens ZLC3700 gamma camera equipped with a 6 mm pinhole collimator set approximately 8 cm from the animal. To determine monoclonal antibody biodistribution following imaging, the normal organs and tumors are removed, weighed, and the radioactivity of the tissues and a sample of the injectate are measured. Additionally, CA-specific antibodies conjugated to antitumor compounds are used for cancer-specific chemotherapy.

Example 14

Immunohistochemical Methods

Frozen tissue samples from cancer patients are embedded in an optimum cutting temperature (OCT) compound and quick-frozen in isopentane with dry ice. Cryosections are cut with a Leica 3050 CM mictrotome at thickness of 5 µm and thaw-mounted on vectabound-coated slides. The sections are fixed with ethanol at –20° C. and allowed to air dry overnight at room temperature. The fixed sections are stored at –80° C. until use. For immunohistochemistry, the tissue sections are retrieved and first incubated in blocking buffer (PBS, 5% normal goat serum, 0.1% Tween 20) for 30 minutes at room temperature, and then incubated with the CA protein-specific monoclonal antibody and control monoclonal antibodies diluted in blocking buffer (1 µg/ml) for 120 minutes. The sections are then washed three times with the blocking buffer. The bound monoclonal antibodies are detected with a goat anti-mouse IgG+IgM (H+L) F(ab')$_2$-peroxidase conjugates and the peroxidase substrate diaminobenzidine (1 mg/ml, Sigma Catalog No. D 5637) in 0.1 M sodium acetate buffer pH 5.05 and 0.003% hydrogen peroxide (Sigma cat. No. H1009). The stained slides are counter-stained with hematoxylin and examined under Nikon microscope.

Monoclonal antibody against a CA protein (antigen) is used to test reactivity with various cell lines from different types of tissues. Cells from different established cell lines are removed from the growth surface without using proteases, packed and embedded in OCT compound. The cells are frozen and sectioned, then stained using a standard IHC protocol. The CellArray™ technology is described in WO 01/43869. Normal tissue (human) obtained by surgical resection are frozen and mounted. Cryosections are cut with a Leica 3050 CM mictrotome at thickness of 5 µm and thaw-mounted on vectabound-coated slides. The sections are fixed with ethanol at –20° C. and allowed to air dry overnight at room temperature. PolyMICA™ Detection kit is used to determine binding of a CA-specific monoclonal antibody to normal tissue. Primary monoclonal antibody is used at a final concentration of 1 µg/ml.

All publications and patent applications cited in this specification are herein incorporated by reference as if each individual publication or patent application were specifically and individually indicated to be incorporated by reference.

Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

SEQUENCE LISTING (203 sequences)

SEQ ID NO: 1 - DNA, 46030 bp, Mus musculus
  misc_feature (1)...(46030): n = A,T,C or G
ggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgatggtggtggtggtggtggtggtggtggtggtggtggtggtagtagtaatttgctgtttaattttttttaacttttgtatttattttatgtgaattggtgttttgcctgcttttttgtttgtttgtttgtttgttcagtttttttgtctgtgtaaaggtgtcaaatcatttgggactggattacagacagctgtgagctgttatgtatatgctaggaattgaacctggtcctctggaagagcaagacaatgctcttaaccattgagccattcctccagcccctgggtttgatttttttgagacaggatctcactgcatggccctgattggacttgaactctgcccctgcttctgcttctgagattaatggcatgtgccaccacatctggctaacctcgggatttttgacaaactaactatacattatctcttcactctgttaatattttacttgaaattcacttgtatttttaaagatctaaatgaatttcttgtgatttttttaatatttatttttgtgtgagtatgcatgtatgtatgtgtacatgcatattgcagcacatgtgtggggatcagaagacaacgtgaaggggtccattctcttcttccactatgtgggttccagaaatgaacttcagcttatcaggtttggccacaagctccttccctggcagagccatctcactggtcccttgaattacttttaaagttgatatcacaaccaaagatagaaaaacacaacacaacaaaacaaaaaccctattttttcttggccataaataggaagtaattataaaataaaaataataaaaagaaaacattgattctaggtggacatctttgactgctcaagggtctgtctacctgagggcagatctctctcttctgaagggagatgtgtttgcattcaagaacagctggagataaacttaatgagcctcagatttttctccttgtataatcggaaaaacaaattcagaggcatacacacacacacacacacacacacacacacacacacacacaatcacacataatctatgtgacctactgctgtgtacagagacacctgaaagtcactgggcctgcagcaccgtgcgtctcagccctgttcatcaaacctgtttagtggctgaaacacagaccaagcctactggttggcatggctggacttcagaaacggacaggagcaaaccagaattcctctgagccctagaaagtacaaccagacttctatctgtggttttcaacgttcgtccagggccaagctgcccttgaggtcaggtttcatttagaaccactccctgtatcttctgcctccaggagacaggttgttttttgttttttcttttaatcttagtcaagcttctcgtaattccagttggcagttggaagaggaagtagtgaaaagtcaaacagcttcctggggggagcccctttatggaacttctagaaagttccatttagaagatagataacgctatgcaactaaacagtgcattatattgttcatggtgtgataaaaataaaaaaaattaaaaaataaaaagcaacaattgagagctgtgggacaaataggtaaaatttacagaccaaagccctgaccctctagaaggccgaggaatttgggaccatataggcagtgagtaaaccccgtatgtggaaccaggtatggtagatcacacctataatacacacaactttggggctagcctgggctacataatgagttccaggctaacctgggctacagagtaagctcctgtcttaagtcaaagtaaagcaaagcaaagcaaaacccccataggctggtatttgatcttcctctaaatctgttaatcctttgtcagaagacagagccgggctggagagatgtctcagcagttaagagcactgattgctcttccgaaggttctgagttcaaatcccagcaaccatccttaatgacatctgacatattttctttcattcgttgttgcatgatttttcatcaaaagaatatgagccaagttgtgtctcgtgcccccagtggagacatcccaaaggaccagaagagaattaggtcactgtctagcaggaagcttactggcaaaacaataaagaaaaaccaagtcttcacccttgagagttaatccagggaaaagtgagataatagggccaaggtggataatggggcttgcagccaaggttgtcaacatgagttttattcctggggcccacctggtgagagaagagaaccagctcccataagctgtcttctgggcttgtcgtcgcttcccttcccacctacaaatgtaagtatataaaaactagttaatatgttaatataaatgaggcctagcttatagtcccagcaatccacgaacagaggtgaagcccatgggtctacatagcaagttctaggccagtggcggttacatggttttatacacacacacacacacacacacacacacacacacacacacacacacacgtgtatgcgcatgtgcgtgtaaaatatagttatatttaatttgtcttttagcatttgcatgccttcaaaatttatgaaaaattagctatttcttacacatgttcgttcagcgattatattttctctcttgtgaattatttgaacctaataacttccttgtagagaacaagtcactcaaaatgctcactaagcacacaaccccagctcctggccttaccctcttgcattccttagtcctgcacccaaaataaacccttacagcctctatccacctattcttctgtcttcacaaatatttactgagcaagtcctacctgccagctgttctgagggatggagacagggtgaacaggacaaggaccacagtcaactcagcagccaacaaagagaaaaggctcctgaatagagtccactgggtagagctaatcctttagataagaccataaagaagaggccatattcaggctaagatatccccatgacttcttatggctgcagttggttaaagttcaccctgcctgccaggacctgggaggccctgcagggtcaggcccagtctcctctgacatcactttatgcccagccccctaagccacacggctcctcaaacccagcccatctgccctagactcctggcttttgcactggctggagtgtcctgtttctcttgaagtctctgaatagcacatctagtgggcactcagctcccatgagaccctgccaacctctccacctaaaatagcccctttcgccccacgaggcgccatcccattgttgtctcgtttctttcatagcaattggccttggaaatgacttcctttctttgcttgtgttttgcttgcctgaactccaggaaggtccagggaggcagagggctcactgtcttgctcattgctccatcttgcacagagatagagacagatgctttcagtacctgctgggagctgggcacacagcacatgccagcaatcccagcacttgggaggtagccttaggaggtgaagaatgcttggctagctgcagtaaacccaaggctagcctgggctacaatgagagcccatgtagaaaggaggtacagcagtacacatcgataatctcagcaccagggaaacagaaacaggcagatcccttaagcctctggccagccattctagccaaatgtcgggaagccattttttggctattttgtgtgttttttctttttctttttctatttctttttccttttctttttctttcttttttcttttcttttctttctcttctttctcttctttctcttctttctttctttctttctttctttctttctttctttctttctttcttcttcaagacagggtttctcttatagccctggctgtcctggaactcactttgtagaccaggctagcctcaaactgagaaatccgcctgcctctgcctcccaagtgttgggattaaaggtgtgtgccaaccactgcccagcgtgttcttcttccacccttcaacacccctttttttcctccctttcaaccccccaatgctaaataagagagaaaggaaggatggagggaagagaggaaagggaagagatcctgaatctaatttcttcctcaacaacaactgcaaacaaatcacaaccaacccccctgaatgaccgacaccaacccactgacccctcctctcagggctccagcatttgtgtaccctctgaaaagtccccagaattccaaacatcacacaatcacagaaactgtctactgctgacaaaatcacacccctactagagcacaaggcaagacatagtcagctgctgtggacagtctgaagtaggcccacatcccacacctgggattaaaacgagaacatattcttaaaacatttctgtgtgttttaaataattatttatttatgtatctgtagctgttttcacacatacaagaagaggacatcagattccatcacagatggttgtgggccatagtgtggttgctgggaattgaacttaggacctctgggagagcagtccagccccatttttgtgttttttaagaaaaccaaaatcccaaaattgtcgctacatcaatcagctccaggttcaaggagagatcttgtctcaaaaaataaagaaaagagcacacgtgcttgcaagcacgtgcatacacacacacacacacacacacacacacacacacacacacacacacacacgttgagagcatttctctctatagccagtagaatctttgctggtcacccctgaaggacaattgcgttttgtaggcagttgtagatacatctccctcttaatagttgactctatgaccaaatcacctacatataacatcttttctatgaacaagttaactgtactcttgatttatagataaaaaattaggatatagcgaaatcatgttaatagatatcatgtttttccgggttgggttttaataatgtgagaagacaaagcatgacagacagagtaaattatcatttttttctagttgtttcttttgagacaagtgtagtggtagataccagtggtagaagtccagcaatcaggggattggacagagggatcaggattcaaggccagcctgggatatatagcaaaaacaacacatagaaaataaataaataaaaacataaagaagaggttggggagataggagatgatggttcagtgagtaagaaaacccttgccccgggtaaaagccagtaggcatagtggctgcctagaatcctggcactgaggagagacaggatccccgtctccccaggaatctgtcaaactagactaaccagaattggcaaactctgggttcagggagagaaactgcctcaataaataaagtggagaagccaggcatggtggcgcatgcctttaatcccagcactcaggaggcagaggcaggcagatttctgagtttgaggccaacctggtctacaaagtaagttccaggacagccagggctacatagagaaactctgtcttgaaaaaaaaagaaaaaaaaagataaaataaataaataaagtggaaagtgattgaggacggtatctaatgttaacagcatgccgctacatacatgcacactcgagtacacatgtgcgcagcacctgcacgtgtacctgcccgtatgcctcctcttccctttcccaaacctttcttcttttgacacactctccatgtaggtcaggctggccttcaactcagtcctcggctaggacttccccataccgagtctttaccttcccagatccacagtccagaacccaggttcccatagggaagtgcaggatatgaagagtttgctcttttgaaataactccctgccactcccttagggtaaaattaataaacaaatacaaggagctgtgagcctgccaggaagtgaggctcctccacgcagaaggagccgtaaagaaaggatttctcggggagggggggggggcgttccattccgttatcctgggaagtgtcttactatcatagccctggctggcctggaactcactatgtagaccaggctgtccacaaagatccatttgcctctgcctcctgagtgctcaggcttcaaggcccgtgctaccatgcccagcctccctgattgtcctgttgcctatatttttccagataaagtcagggaagagccaggagtcaggtgcttggcaatcctccatcccttcctggtcatattctttgttcagtgccacagagatggtacagagggttctaataagcattcccactgagcaacatggtggtggcagaggcggtggcagcagcagccacggccgcctctggtgctggagtactacaggcagcactcagtgttaccttttttttttttcttttagacttagtgttttatttgatgtgtttacctgggatatgtatcaatcacatgtgtgctctttttaaaaaacaatctttaattcttagttttgttatttttttaggtgtgtgtgtgaaagaacctagtgaggaaacccccactcaattccctattcgacgtgcacccaagaatcacgaacagacgaccatcttgatgtaaaagcatgaggtagtttaatgacagagctccgggcctacacgtatctcccgcaggagacagaggtgtcgaccacatggtggaaccataatggcggagctccgggtcgaaaggtatctcacaaaggagacagtggttccaactccatgcttggaagctaggggtttttatagaaaaggggtggggctgggggaggaattggcgcggtttcacatgattggtccatttaaacatcaacagactgtcagaagggtgggagatagggaggcaccaggccagtccggacatgtaacaacgggcctgcccgggcatgtcctggcctgttctgctatgttctcagccccaggtttcaaagctcacaaacaactctttgggctatttgacatacattacatgaatcacaggtctcaagttttatttcctttcatgtgttgtgtatgtgtgttgtattatgcatgatatatatatatatatacacacacacatatgtgtgtgtgtgtgtgtgtgtgtatatatatatatataacatgcatgtgcatttgtgggtacacgtgcctgtgtgtgcacaggcagaggccaaaggagaatgttggctgggtgtcttcctctatcgttctctgccttagtcccttgacgcagggtctctcactgatccagaagctttggctaagctgcctggctagcaagcttgtctctgccctccaaggctggggttacggacatgtgaggccatgcccagatttttacatgcatgttgaggattcgatacttatgcttgctacatagtgagacactatctaatacatacataatacatgcacacacacacacacacacatacacagagatggatgaagagatagatagatgaggggtggggggtaatgggctcttgggactccaaaacaagaagacaacaatttaatctataatagaaaaaacttgggggctgaagagatggctcagtggttaagagcactgactgctcttccgaaggttcagagttcaaatcccagcaaccacttggtggctcacaaccatccataatgagatccaaagccttcttctggtgcatctgaagacagctacagtgtacttagatataataataaataaatctttagaccgcagcgagtgggactgactggagagagcagaggtcctgaattcccagcaaccacatgatgattcacaaccatcagtacagctacagtgtactcacatacattaaataaataaataaatcttttttaaaaagaagaaagaacttggactgggatgaagctgagttggtggagcacttggctagcacacatgagaccctgggttcagtgctagacactgatgaaccagacgcggtggcagaatgatacctgtctgtgctcctggcacctgggagatagaggttggaaggtcagaaggtcaaggccatcctcagtcaacacagacaattaattccaggacagcctgggtaagatgagatcctatctcaagtgtgtgtgtgtgtgtgtgtgtgtgtgcacgcaaataaataaaatacacaaatgatttgaacagataacttagagagggagacacaaacgcctaaaataagcacatgaaataattttcaacatcctttgtcatcaggagatgtaaactaaaactagattgagaaactactacctaatggtgtgcctctgtgcccaagccagtgtggctccagaagtcctagacagtgctggcagagagggttaggggttctggggtggcccacctttgtggccaagccggccagtccttagtagccctggtaagctccaggatcacccacactggggttaaacccacaccactgtgtccatcttttaacatggatgccggggtcttgaccgggtgctgactacactcacacccctctcccagcctctttatcatagtcctcttattttttaatattaatttttattatctttaagactgtgtgtacatgcctgccagaggtgtggattcccctggaacctgagttacaggatcagttgggagccacctggccggcgcgttgaaagcagaacacctgtcatctgcaaaaccaggaagtacttttaacctctaagccgtgtcttcagccccctatcgtagtcttgagtggagaccctggggacaataggagcttctgagcattaatatgatttttagattgagaacagagttaagggtcaggttaaaggacgtggggatggttggtgtatcttcctctgggtggggctggatctcaggaaaggactggattaagcaagccttatcaggtgacagagctggctcctgagatggtgggagctctagggtgggagaacaaagggttgaggcagtgatgcgtgagcacacattgaacccccaggtgacaggggataatgactaaaggaccctttgtgccaactcccattgaggaggacttcactctattcccctaagttttcagacagacagctcttctgagatcagtgtcctgcttcggtgactgacaagcccctctggagaaagtcttaggagaaggggcgctggtatgccttgtttcttctctagaaagccctgtctctacccagggccgtggacagaaggcagagctgagcgcagaatgatcgaccagtaacaatgggcctgctttgccaggaggaagcagccttccttctctttgtgggcctcaacaaagctgtcacccccacctcccttcttcccttcccttttttttaatagagaggaaggaatgcttttaaaaagtgactatgatgccattcacatggtgattgttctgttgctgtttgtttgattttattgttttgttttgttttttaaagacagtcttaactaggcaaccctggccggcctggaactctctctgtagagtaggctggccttgaactcacagagatctgtctgtctcttctgcttcccaagttttctctttgcttgtggaatttcaaattggcctctgttaaaattggacccacgacagacggtgggccaaggtggttatgggaaagggagcctaccgtcaataaccttcaagcctgcttctaataggagcatgacaactggggtctatgtccagttaaagtgatatgtgagatggagggaagcttggaaacgttagctctagaagtttctagaagtgaccattaggaaaagcccagtgtgggagtccacagcaaaagatgacacaagtcaagtcataaatagttggagaaaacatgaaaggacttttcaggtattcttggaacagcaggtagagaaaatagaattctttgcagtcaaatggtggggagttggggaggggagggcccagaagatgactcagagttaaaggcatctgccactaagcctgatgacctgaattccatcccatgatcccacatggtgaagggtcaagaatcaacccttcccaccatcctctggcagctacatgagcactgtggtgtgcacacacaaaataagaaggggtcagaggtaaggcaatcatcgttctcggctagattactgagtgtttagagagacagtagtaggctctggggaggcgataggtctaccattcccaagatatagagagattagctgaatacactcacctttgaccttgcaaggatttctaaagagaactcagacttctacagttgtcctggactttgagtcaaggatatcaacctgaagctgggctcaagtgacctgactctgaggttggaagcagcccatgctgtacgaccagagaccagatcctgaccacgaattgcctttgcctctatcagttaatgagtggacttcggacttgaaagacagttaaaactccaggcagcgaaggagaggacacatttcctccttggattatcaagcaagagcagctaccatgaaaggcttcctgcttctctctctcagtctccttttggtgaccgtgggtaagaaactccttttttgttattttgtggttgcttctgtaacttgataagttgaattggtatcgtagtctctgaaacagaaacagcaggcttgatcctacaactttttaaagtggctgctagtcttgacttggggccatttcttgactagctcagctcggagatgctgacattttcatctgtgacccccaagacagcagaggcaaaagaagtctatggctgacattgggacacagcagggcagaggtttgtctgaagttggataaagatgactcagtcgtgcaaggatgaggttagcaagctggatctagatctgttcctgtgatcatcagagagtcagacctggaggggtcggggatatgtctgttttcaccaacacttgaaactggggatctctggccaaaaagagcaatcccagtgggggttagagcccctacaggtgttcttcttctggactagggagagtttatctgggtttgagtaggtaaggaatttgtcccccaccccaccccattctgagagaaatccagatctagacgtcaaatgcaagaaaggaataaggcattggaggcagtggaagggggaagagaaattgagttcaatgtaaaggaccacttgacttgctttgtttgggggatggaatctcgtgctaccaaggttaaactgaactctccatacagtagatgaacttctgatccaactgccttggagtgctgggttataggtatgagccaacatacatggcaagataggagcttttgaaacctcttactacatttaattaccatacatgtggaggacatcggacaactcccagaaagtggtttctctcctcccaccccctgagtgagattgaacacagccggccagccttggcagcaggcttcttttctttctttcttttttttcttcttaatttttttattatttaaatgcattttatacatcaaacacattaataatattgagtattttgagaatcaaataacattaaaaatgtgttcaacttttatattcatatcctttcataccctaaaaatatcattaatggatatttaatactatccataagcaaacttctttctttattccctggaccaatattttttttttgatctgcttttaagattgggggagaagagctgtcctaagaggagggtaggcctcaccagatctcctctgccaagcctgggtgctgtggccaagtcttcaggtcccaattagaactgataagatctacgtgattttctggagtcaccatgaagaagaaatgccttctgtaagacataagggtactgagaagggaatcctttgctgggaaggcttggggaaatggctagaggttagagaattcgtagtcatggatctcaaggtaccttagaggtgtagaaaggagacttgggccagagaattcccccagcagggtacaggagcaggctccacacttcagagcttggtaggcagggatccaaatacagtgtagtcggttactagctgtggtttctccttccgtaataacagaggagacagcccacagcaggaagcttaggctcacagcactgtatctgccatcggatccaatatttaaacatttgtgtttgctcttgcttgcgtatgttccatgtcggtctcagcagttgaggacaggaggtggatcttatacaccttccacctgtctcacccagaaatgtcataaggacttcctgaacaatgaggacatgctcagatgacatcttaagccccctcaggatccatttgccagcgttttgcttcccctgagcactagggctcctctttcccatggcatctagtgagagccagcatctcttactattgaggacttctgtctgtcagaagcattttagtatggctctcagctagcattgggtaccatgtgctctgggcagatggtggtcctagagtgttctccagaaaagaacccataaaaagaacttttttttctcatttaagtcaatagttggcaccctatagttgatctatagctgtagggttattactgtggtgtgggttagaaagcagctctcagatctgaggaaacagaaagatggaagctggggctggagagatgcctcagtagctaagagtgtttatagttcttgtagaggaccggggctcacctctcaactggaactccagttgtataggatccaatagcctcttctgacttccataggctcatgcatgcctctccacagacctctgacaaagttgtagttcaaacagtgccatggacaaatcatctcaaccaatgcccacgggctcttcacaggtggcatttgtgtctgtctcacagggtcacatcaggtatagggtaagcccttgataaatgagaaagtcccaggagatgtgaggcagtgggccacgtgactgtggtcagctagtgacgattttcttggtgatggaaaaacaattgcttatctctttgtctcttctagttactagtagccaagccctgtccaaggtgaagaactgggccttgcctggagcatcttatggtccctgggggaatcatagtgaacattagcatcctatatcatagggcttatgaatggcttcctctctacaaaggttttcatttaataatttgtataatctgttgtcaatgtcagagttcttagagacaagaggagtcccaagaaatgggtcactaagtgggcgactaaaaggtagtcttccaagcttcctagagagttctaggaaagcggtaaatacagctttgatgtctatcacagtctttaggacatggaccatttatttgtcttattatctcaaagcagatgtatctagagaaatgtgtaccaggaaacaacaacaataacaacacaaacaaacaaacacactggtccagcactcagaaagattgggaatttcaggccaactacactgcatagcaagacctgtctcaaaaaaaccaaaccaaaatgtggaagaactataatcagcactcggtgaagtgtccagcaacaagaggctcaggacatcctttgctatctatcaagttcaaagctagcctgagctacaggagactatctcaatttacaaaagaagatatctttttttttactcactttgtagaccaggctagcctcgaactcagaaatccgcctgcctctgcctcccaagtgctgggattacaggcgtgcgccaccactgcctggcttagtgagttgtttctacgagattattctctctttttttttttttaagatttatttatttattatatgtaagtacactgtagctgtcttcagacactccagaagagggcgtcagatcttgttacagatggttgtgagccaccatgtggttgctgggatttgaactctggaccttcggaagaacagtcgggtgctcttacccactgagccatctcaccagcccccgagattattctcttaaaaccaacttctcaggttcccttcaacatagaaaactgccccaatgtggacaatctggtctgtttccctggaatgtagaaagaaggcactgcctggtggtaacagcgccatcttgtggcactttcaattgtcttcctctgaatgtcctgggaatttattaaaccgttttccaaatatagatataaattgctatttcttggtattaatgtcttcttttgtaaattgagatagagtgtcctgtagctcaggctagctttgaacttgatagggagcaaagggtgtcctgagcctcttgtctctgtcgccaaagttcggatactgatctcaatggttttgttgtttccgttctcagttttgcaacatggcctcatgtagcccaggcttgcctccacagacatataccaccactcccgacttgatactcttcatgaatgttatcaccacaactctacactcagctagctctccacaggtataattaagctatgttaggtgtggtagttttcaataatattttccattttttgtctgttttttttttaattttgttatgctgagaaggagccacttttaacataatcaagtatattcatttcccccagaaaatccaagatgagttttggttagaatggacagtaattgctattatttatctaacactctgtcctctgacatttggctaccttgttcccttaaccaaaatcacaacagcctctgcctcaagtattgttaacaatctgcctgagaatgtagccaatgagaccagagatagttcaattctgtcctctgtgacaaccaagtctgacaagaagtctgggacaattcagaccaaagggaattcacctcagcctcctgagacaaatctgtttcctagtgtcgccagctcttccatggtgactcgcggcactaatcctcccaccgtgggactctgtctacaggtagttcatctcaggcctctagtacaacatcgtcttctggtggcaccagtcctcccaccacagtacaaagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggtctctactacaacatcgtcttctggtggcgccagtcctcccaccacggtacagagtcaatctccaggtagttcatctcagcccggaccaactcagccttctggtggtgccagctcttccaccgtgcctagcggtggaagcacaggtaagagtggtccctgaaaatctcactggggtacagagcaccgaagtctgtgatgtgtcagtatgttctggtgaggaaggggaatggtaccgaaggaacccctaagttagcgctcagttatattctttcccttcctgtcccttaagctactttacaactgtggaagatgctcttttaagtttggtctttgtgagagctgcccataggagagctggaagtagtttcaggttctctgaaaaaatacaggttagactaagtgcttgctggcttgtcagccacactgggccttaaggaagaaatcggctctaccctggaatccgtcaggatggtggctgatcacagttcccacactaagtcaagcctttgaatttgggcccaagggttaagaagccaaacaatgactgtcctcaaacagttgatggctgactagggccaaagtgtgattggccataagcaatgatactaaaccacttgacaagttctccaaacttgatctagaatgagtgtcagcaaagtttatcagaaaaaaacaaaaacaaaaacaaaaacaaaaaccagagagtatatattttatgctttgtgggcaacatgtggtctctgttgaaacaaaacaaaagcagccgtgtcaatgtacaaatgaatgaacttggctatatcccaataaaaatgtatttataaaaataaagggttggttagttacagctcatgggccataatttaccaagcactggcctagaggactccccagacttcagaatttagagttcaaatacatcacgtcattctaggaaaaggaaactgaggcccaaagagaacagtgacttgccccaaagagatcatttgtatctccttgcacttttgatctctttccaagttttccttgacagatatctaagaaatcagttgggtcagtcattagaacccagccatgtgggcagctgtggtggtcttagaaacgggagcttctccaggccatttctgcttcctccacagcagtccttcatgactcctcatgctggctggcatgaggcaaactgcttctctcttggctccagtgaactcacttaagaccttgagattaatgttgggggtggggggaaatgcctttaatcccagcacttgggaggcagaggtaggtggatttctgagttcaaggctagcttgacctatagaacaacctatagaacaaccaagacttcacagaaatcctgtctcagaaaaacaaaacaaaacaacaaaccattcctttgaaactaaggagtgatgctcatcccttccacctttaaggtctaacgtgattagcgtgacttaatcattcctccaccaatcactctcctgagtttgccctttatttccagaaagaaagcatgtcttgttgtcctgcgttgcttgtttgctgtcccccagagagaacccgcatcctatcctatttctccttgctatggggctgaatccttttttttttttttaagccatttagtttacttaacatacctggctttgccgggtgtagtagcacacgggtagtcccagggcttggaagattgagacagaaggatcaagtgttcgaggctgtccttggctatgtaacaagtttgaggccagcctgggctctaggagacgctgcctgaaaagtttaaaagaggagccaatgagatggcacagctggctaaagtgctggagttccatctccagaacctacacacatgtgcctattcatccatcccacaggaaacgaataagtgaaagaattcttttaattaaaaaaaaatccaataaaaggaaaacacagcaggcccacggttgtgtcagtaaagcttaatcaggacaaaagggtaagcagttaaagcccgtgtccttttcccctaaactccatggcccttggagaactctagaagcaacctctactgccagttcctgtgtcccccttcagagacaacctaagcaaatgcaataagtacaactgctctcttgtcacagaggagcatgtcacgcatactgggtcttaaaattagctttttgaactgggagaagtggcgcacgcctttactcccagcactcagaaggcagagaggcaggcggatctccgagttcgaggccagcctggtctacagagcaagttccaggaaagtcagggctacatagagaaaccctctcttgaaaaaccaaaccaaacaacaaacaaacaaacaaaaattctttttgaaaaagctccagaatttgtggagatgaagaaaatagtgaaccagtggctgaggctatagctcagtggtagagcatgtgcctagcatgcatgagggcctggttcaatccccagtcctgaaaaaaaaaacagaagaaagcaggcaggccaatcgagatcaccatgtgctcgcctgtagatgtccctcctccaatcttactagtttcctggaaatagggcctgagccatgtgtgtccaacccaggaatctaggtcagggtgcagggtccatcgtaatatttctttgttctgaatcctcccttgcagagtcaagggtgcagcatgtccttgatgctccccctagaaaactactactgggttgcccaggccactctaccctgaatggacttgatttcacgggaagctaagcaggttggacttggtccgtacttggatgggaggaagttcactaggttaatctgcattcttcttaattgttccttttctttgttggttatttcttttgagaaagagtcttcttccatagcccaggctggcctgaaacttactctatagaccaagctggtctcaaactctcagagatccaacagtgtccaccttctggaggctgggaataaagacatgtgctaccatgcctggctgtctctccctttcttcatggatgtgtgacagctctgctcctcagaatatattcccctttggaacttcctgctatcctgccctgtctggtgattaccgcgctgttctataaaaggctgctttgtttaaaaagggtttggggagccttccttagtgtttgggagcaggcaccgatgccctcaggatctgaagagcctccactccttacaagtagaaagctactcctcttttaaacagggatctaagaaagcagattgggggcaatctctaaccttcactgccggcaaacagtcagcccccaaaccatagtattgatcttccccagagaccgaagcaaacacactgttaccaggccttctaaagatgtactatgaagtcatacaagaagggtagagaggccaggtatgttggtgcacacctttgatcccaacacttgggaggcagaggcaggcaggcctctgtgagtttaaggctagtctgatctgcgtaggaatttgcaggccagccagggtgagcaagcgcttccagaaggagggtgtgaagagtagatgagactcccaggagttactcgctgaggtctgtggatttgtaatgtctttctcctccatctaaggtcccagtgatctctgcaaccctaacccctgtaaaggaactgcttcttgtgttaagctgcatagcaaacacttctgcttgtgtttagaaggctattactacaactcgtctctgtcgtcatgtgtgaaaggtaagtgccaaaggacagccaaggcggagccctgcatctcatatctggaagtggactttacagggatctcaaacaatagcaaaaggggcagaggaaaatctgaaggcaggtgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttatgaagtagcaacaaaaataattttatggttgggggtcaccacaacatgaggaactatatgaactgtaatgagtcacagcattataaaggttgagaaccaatttttaaaaatttttattagtagtagtagtagtatttattttatgtatgtgaatacactttagctgtcttcagacagaccagacgagggcatcaggtctcattacagccaccatgtggatgctgagaattgaactcaggacccatggaagagcagtcagtgctcttaaccactgagccatctctccagcccaagaaccaacggtttaaacgatattttttgttctgctttataagtagaaaattgcttttcctgctagagcagatcagttgtataagaagcagacagactatgttgcccacaatagttagagctatatctccctaagtttgtatttttagcactaataatctgatttctgggtatctactccatgtaaatggtgccccccccaagtctttccattttaaatagtatgcaccaagttcaagaataaaaacaaaaataagccaaagacagtggcacatgcctttaattccagcacttgggagacagaccaggcagttctctgtgaatttggagctagcctggtctacaaatggagttccagatcagcctgtggacaggaatacacagtgagaccatgtttaaagcaggggaaatgggaaggaaaagaaagagagaaagaagaagaaaagtaacacactttagacacaaaactgcaatggccctattaacattaaatggttcagagagggtttgcctgattttcaggaacgacattccctggggacattagcatgagtgtgtctgaaacagccaacttggaagatgaaaactctgtgggctatcaagagttgtacaacagtgttaccgattttgtaagtattttcccactttctcatctatgaagtatcttccttctcagctggaccagcaaagcatgggactgatcttcatgtggtcacatgacacaattgtgctttttgttgacaaagtgacatgtaccccttctagaggacaggtagctccccagggattcttgggcgtccttgtggttgtgcatctgtacgctcacccagcatagccctgccatgcctccagaaagcagccttgggactccgctccagacctgccagttagagaagctattggtgtggttttaaataaataagagctctaactgtgtcttttgaaacaaattagtttgtggggtgtagtaatgtacgcctttaatcgaagcagaagccagagacagagaaaccctgtctaaaaaccaagagagagagagagagagagagagagagagagagagagagagagagaggagctcagaaactctctatagcgttcagccagccagtgtttagacacctgagctcagtcaggggtgtccaggaggcggtcaagcattgttacagttttaaagagtgtttttgtttatttggttttagaaaacatttttttgtttgtttgtttgttattttggttttggatacagggtttctctgtatagccctggctgtcctggaactcagaaatccacctgcctctgcctcccaagtgctgggattaaaggcatgtgccgccaccacccggctagaaaacatttttgtattattgttctttttcttttctatgaattatttatttattttacgtatatgagtatactgttgctattttcagacacaccagaagagggcatcagatcccattacagacggctgtgagctaacatgtggttgctgggaattgaactcaggacctctggaagagcagtcagtgctcttaaccctgagccatctcttcaactcccatattattgttctttttaaaatattctatttattgtgtgtgtgtgtgcatgcactggtgtgagcatgtcatattgttttgtgtcaaagacaacattcaggagttggctttccttccaccttgctaggacatggtctcttgtttctgccacactttgtatattccaagcaagctggccttccaccttccggatgattctcttctctttgcctttcatcttgacataaaaagggaaggagggggagggagggagggaggaaagaagtgagggagtggggagggaggaaagaaggaaggaatgggggaaggaagagaaaaagaaaaacagaaaagaaatgtttaaacctagaatataatttaaatttgtcccccttgttattacatctgttttcctccacagtttgaaacaacatttaataagactgactatggacagactgtaattattaaagtgaggtaagttggctttggaccagtgaggtactttggaggcagcatatctgtgcttcatgtctgctcttcttgagctccccatgtcacaggccatcttgtgttaagtgatacgtcaagaagaaatagccgcggggccagggaggtggctcaggtggtaaagtgcttgccccacaagcacagggaactgagtttggaaccccagtacctacataagaagcctcagttggggaatggagacagtgagatccctggagctcactggcaggccaacctaggcaaattggtgagctccaggctcagtctcctaaggtagactgtccctaccccttcactggtggatagagccatggtgttccgggatggggtttgccaatgtcatcaaggataaaggctactttaggggacaacaggggaatctaagggacaatgagagggtaaactggctacgatgctcaaaaatgctttgtgatccaggacagaaacaaatacaacacactcaaatatagggagacagctcttgtagcggacaggaacaccatctttcagaatgcttacgccggctgaaagggagtataacagcccgtgctcatgaactactgaggtaatgtgtggaagccacaggctacagcacttgccagctgctggccgacaggctccttagcaggtttggcatggccaaggagttcagaggcaagtggaggtacatggagaagaacacatcgtggaaaaccctggtggtcaaccaaggctttcactcacccactgtttgatgccacttgccagactggcaattggtaataaagttctggggcccagaaaggagctgtggatagaggcttatctgcccacaggtcacagttccaggtgattcctggtcaagatccagggaagcacataggaagcacaatcatgggccagaacattgtagattgtgagagggaagaagattaaataggcttataaaaacagttcttgggcccagaagatggctcagtgcgtcagccaaattcagtgacctgggtttgatctccagagttccagaaagttgtcttctgaacttcatatgtatgtgtatgctgcagcactcacagactcacacctgcacatgcatgtacacacacacacacacacacacacatacacacacacacacacacacacacacacacacacacacacactcatacaaaagagcacacgtgactcagtggtgcctctaaaatcctactgactccagccagcgtagacaggctgtggcctgagatggaaagctgtggatgtctgcccagcatcttgttcacacggaccttgttgtatcctttggttgtaaaccatacctggtttgagaactccaagtaccttccaaaagaatgttgtcttgggggctggagagatggctcagcagttaaaagcactgactgctcctccagaggtcctgagttcaattcttagcaaccacatggtggctcacaagcatctgtaatgggatccgatgccctcttctggtgtgtctgaagacagctatagcgtactcatatacataaaataaataaataattcttgaaaaagaagaaaaaagaattgttttcattatagttttctctgagcacacatcaaatagaagccagcaggctgaaaattcgacactatgttacccccaggcctccatatgtgatctacaatgggtcagggctagagcacacacagcagacttgggcatcagggacgttcagatattgcttgttgactcctcagtttgatttatccattgacacccctacttctctttcagcacagccccttcacggtcagcaagatctgcaatgcgtgatgctacaaaggacgtcagtgtatccgtagtaaatatatttggagcagacacaaaagaaactgaaaagagtgtatcttctgcaatcgaaactgcaattaagactagtggcaatgtgaaagactatgtcagtaagtgctaagtaattttacttaaagtttgcctaaaggtctaactttcaagccagattgattgctgtctccaaaccctccccaccctccccctctgtgtgtgtgtagtgtgtgtgtgtgtgtgtgtgtgtgtgtgtgtgtaagtcaatctctgcaggtgttccccctcaggagccatctaccctgagttcatcttcctggggctggggcttaaacctaggatcccctggatgctaatcaagtgttctacactaagccaccccacagaaggctaccttttttctctgataagtgagatagctagtctggcaggccagtggatcccaaggccctcctatctccacttcttcagagctagagttacaagtggacaccaacatgcctgctccccacaccggccccctgtggttgcttgagattgaacttgggttctcacacttgaacttgggttctcacacttgaacttgggttctcgcacttggacttggattattgcacttgaacttgggttctcacacttggatttgggttctcacacttgaacttgggttctcacacttgaacttgggttctcagacttgaacttgggttctcgcacttggacttgggttcttgcacttgaacttgggttctcacacttggacttggattctcacacttgaacttgggttctcacacttggacagcagcactttattaactgagtcatctccctgacccctgagttctgtttttcaaaacataaataaatgtgttcacttagagtttcccaacacctttttctttgggactttacaaagattctttcttctcgtgtgttatgtgttaggacctagagtgtaaaatactgtgagacagagctctgctgtgggacctaccactgctaatccaccgatgtatttcttgggctcataattttgtctagagtagcagtggccttgcgccctgggccttatgttgtttggggctagataggccttagcacactcatgaagaaactgagagtccccatcagcatgggcactgaccacaggtactcatccgctaagaacaatttacccatttctcaggataatcttggggagccccctcccccaactccagtgttctcatttttacactcctgagtaattgcttcgcttataatccctcattttcagagctgaaactggtcagtgtcagatctgaaacgcactttttagaccacctctctgaacacctccctccactctgaaacccgtcctgtgcgattaagtagattaaccaagtcccctaaactgatgtctagagtcagacaaagcaaactgccccagatggaagccaatgcctcagcgcttagaggaagtcacgctgctcttcaggcctggtcacaaaaatatactctctttctctagattttgaattgaaggttgtgctggctagttttatgtcagcttgatccaggctagagtcttcagagaggaggaaacctcaactgagacagtgcctccttaagatcaggctgtaggcaacctccggggtacttgcatactcagtgattgatggggaggccccgcccacggtgggcagggccatccctgggcggtggtcctggattctataaggaatcaggctgagtaaggcagtaagcaacacccctccatgacctctgcatcagctcctgtctccaggtttcttctctgcttgcatttctgtcctggcttcctttgatgatgaacagtgatgtggaagtgtaagctaaataaaccctttcctccccagcttgctctttggtcatggtgtccatcacagcaatagaaaccctgactaagacataaatagtttcaagccgcagtgggttagttacagctcgggctctttattagaggggaacaccacttttctaactccttctgccctctgctccagtcccctctcagattcaccttctcaccccgagcacttgcaatccaaacccagactagcattcttcgaaggcggttctctcatgacaagttcctgcttagcatcttccagaggactctctagcctaggaataaaagccaggggctggagagatggtcactgtttgagaacacttgtttaattgtgaaaactgaactggggcttgaatcccagcaaccatgtcaggtgcctaacaaatgcctttaactgcagctccagagagtctgacaatctgacgccctctgctggcctctgtagaaacatgcaatgcacacctgattctctctctctctctctctctctctctctctctctctctctctctctctcacacacacacacacacacacacacacacacacacacacaaaactataaaattaaaaaaaaaatagaacagtgtcaaaagctgagtgtattggcacacacctttaatcccagcactcaggaagcagaggcagatggatctctgagtttaagactagcctggtctacagatcaagtttcaggacagccagggctacacagaaaaaacaaaaacaaaaacaaaaaaaaaaccctgccttgaaaaaccaaaactgaaacaaacaaaaaactaaaaactttagtgtccttagcctaacttttaaatgtcactgtatctacaaatgaacaaaatactgtagggttattgaggtccccatgtgggcgccgtcatttacattagctccttctgttctcactgcaaacatggaaacaagacttatgagagccgttttataggtggaggaaacgtggacacagaaaactcaaataactgaatgactgcatagggagcgagggtgaaatgctgtcacgagttatctatatgggcttcctcaatgtgcttttttaatttggtgttttgtgtatttatgtctctcacaggtataaatttgtgtgatcattatggttgtgtagggaatgacagcagtaaatgccaggacattttacaatgcacgtgcaaacctgggctggacaggctgaacccacaggttcctttttgtgttggtaagtgttacaactgctttcaaacttaccttcccactctcactccatcctctagtattttcaaaaaacaatcatggctgctttgggttcccatgtatattttgactttagcctaggacctgggtaagagttggtgtggtgcccatggtcagcttcacatgaggcacatccttatgttacttagaaaagaaaaaaaaaacaatgcacaaaattgtaatatgttacatgccatcttggggttgaagagattgtctctggggtggtgagatggctctaaccagcaaaggcacttgccaagcaagcctggcgacctgagtttactcagtttacctgagagaactgactgctcagaaagtaatttgtcctgtgacttccacataagtcctgtggcatgtgctctctaacacacacacacacacacacacacacacacacacacacagcacacacacacacatttcttcttcttcttcttcttcttcttcttcttcttcttcttcttcttcttctatttattttttatttatatgagtatactgcagctgtcttcagacacacaccaggagagtgcattggatcccatgacagtgtgtttggagttgaactcaggacctctggaagagcagtcagtgctcttaactgctgagccatctctccagccgcccccctccttcttctcctcctcctcttcctcctccttctttttcttcttcaagagattgtttctgaaaatgacctagaaaccactctgttttaaagctgtaacgtgctctcagccctgcaatgcagaggagaaggagcagtgcttaaagatggataacggagtaatggattgtgtgtgcatgccgggctaccagagggcaaacgggaacaggaagtgtgaagagtaagaaatcacttcatttttatcttgtcacaacatagctaggccaaagcttgtagcacatatgctggttcagtgtcaggaagctggcaagttggcatgggttggcagagagagagtatcatggtgtcatcaccatccaagaaggttggttggttgttttgttttgttttgtttttcctgaagatatatttattcactttgtgtgtatgagtgctgtacctgcatgccagaagagggcatcagaccccattctagatggttataaattaccatgtggttgctgggaattgaactcaggacctctggaagagcagccagtgcccttaaccgctgagccatctcatcaatacccatccaagagtttttgagctttctgtattcctagacactccagtaggtagaacctatcatgcaacagttacaaacatgttaggtgcctattccaaaatgaagaaacaaacctgaatgatgacacgggcccttgagagggtccatctactccatgcttttacattcagctttgcctgaatggtcaagctttcctcgagttcagaggctgttatgttcagtcttcagcaaataaggccacagtggattgagtgcacctcacccttccagaaccccatggaaggtattctcttgagaaagtggtagcataaagaagatgtcaggggggctggtgagatggctcagtgggtaagagcacccgactgctcttccgaaggtccagagttcaaatcccagcaaccacatggtggctcacaaccatccgcaacaacatctgactccctcttctggagtgtctgaagacagctacagtgtacttacatatattaataaaataaatcttttaaaaaaaaaaaaaaagaagatgtcagaaatcaaggaaggacagaatgaaaggcagacagaaagggagaaatggaaattgggctgagaattaaagagactctttaacatggctccctactgtgaatgtgttccaggtgtccatttggctacagcgggatgaattgcaaagaccgtgagtatagatacactaaactcctaaacatccaagaaatacatgcagactacatccagagccctgctcactccaccaaagtttcctgaactcactgagagaaaaactcagctctgagcttgtcttctggaccctgtaccccacattcacctgtgttagaaagaacagaactcagacccaggggtgagctggtggctctgaacccacataggaccaaagaaaggcatccttagtcatctactcagattctatattatagatcgtgtgttcaataatgatgggtactggtgaacagtttagaaaccaggcatttaaattcttaagcaggtcttatcaaatttcattcattcattttggaaacagggtcttactatgtatcctgggtggcctaaaacccagagagtcacctgcctctgcctctggattaaaggcgtgtgccaccattgttggcattagtgggttttccaatgtttttcagactgtgtttgggactgggttatgtgttacgtttacgggctatcttatggtcatatttcaaaagtctatagtagccaggcagagtggtagatgtctataatcttagtactaggatcgttgagacatgaggactgctgtgaatttaaggacatcctgggctatataataaaaggtctatagccctcatctggggcagataaagagtattagcattaacagactcctccctagtaagccattacctgccccctctactggtgaccctggtggcgctttggagggcaggcagtggtaggagagatggagagaaagatgagagacctcagctgagattgcatctgcaattttatagctggaaaggctgcttgtgatgaccatgtgctgcagacatggttaaaacatgaggacaaggagagggtggcaacagagacgaacgcctgccctgcttgcctctgtgatagagctcatggtgggagccactgggaacacagcctctgtgcagtagttagcaggacccatgcgctgaaggctgccagtttgttctagtttcatttcttttgttgagacaaatactctggccaaaagcagtataagagagaaagctactcgggcagtggtcacacacagctttaatcccagcacgcgagagacaaaggcaggtgggtttctgtgagttcaaggctagcccggtctacagagtgagctccaggacagccaaaagctacagaaagaagctttggggggggagcggggagagagaggggagggcctttgtttggtttataattccaggttaaagtcttattattttgaggaaatcaaggcaggtattcaaacattgcatccacagtcaagagtaaagagagaatgaacacagggatccttgctttctgcactctggctcccatctagctctcttctctcttactgttcaggaccccctgcctagggaatggtgctccccaccatggactgtatcaattaacagtcaagacaaccgctgacccagacataagccatcagctcaccaaatttagataatgcctccttaagatactcttttttccaagttgtgccgtgttgacattaacactaactgggcctctcttctgttttccctttcagaatttcagctgatcctcaccatcgtgggcaccattgctggagccctcatcctcatcttgctgattgcttttatcgtctctgcgaggtatgggggtggatagatgctgctaaatatgctgctctccagatgctcctagacactcatgcatgagaaaaaggaaacaatatatttattatataagttatatcacaatttattatatttatattatatattataattattataaatatattagtatatatcatataatattgtatatgtaatatatgatatgtgatataaatgtagcatatactaatatataaaacaatatttataatatattaattataataatataatgtattatatgtaatatactgatatgttacaggcattatttatattttaatactttatagctatcatttatacattatatacaaaatgcttagagaaaataataaaaataaatcctttaaaaagaaaggaaattatttgtttcttttatatttatatatagtaatatgtatttacatataacatatttaaatataatatataaataattaataagtgatttataaataataaataagtaaacaatatatctatatataacagtatgttatgtattttatgttatgtaatatataaaataagtatatgtgagacaaggtgtccaagggatccggaggattccttagaagtggagtcacaggcagctgtaagctcccagcctggtgctggaccctgaactcaggttctctccaaaagcactgtatgttcttgcccattgaatagaactgtccaatggcttttacttaattctgtcttttcaggtgatactatatacatggctaaatgtcctttatgattaaatattgttgtttaagttgcttcacatcaatcagactcaataatcagtttctatagcaacaactcttccctagaactacctgtgatacctttgatcccagcactcgggaggcagatgcggcaggatttttgtgagttcaaggccagcctggtctacttagtgcgctccaagacaaccagggttatagtgaagcctgtctcagaaaacaacaacaacaacaacaaaaccaaaactcataccttaagaaactttgttgcgctccccgagccctcattaaattttctgattttaggtcaaagaacaaaaagaaggatggagaagagcagaggctgattgaggatgacttccataacctacgactgaggcagaccggcttctccaacttaggagcggacaacagcatcttccccaaagtcagaacaggggtcccgagtcagacccctaatccctacgcaaaccagcgaagcatgcctcgccctgactactaggtgagtgcggcctctggcttggcaggatgtaatgcccaggtagagagcggaggcatggctggagaggtggctcagcggttaagagcacgtgtcactcttaccgaggacctgagggttggttgccagcactcacatgatgatacaggtgccaggcaagcacacggcatgcatacataaatgcaagcaaaacactcatacacataaaagaagcaaacaaatcttttaaaaaatattagcaaacaaggaggtcccagctacagcctcagtcaccacttggtccctagctaggactaatggccgtctacatgacatcagccctgtctctgaatgtctcggggcttccatttcctcttttattttttatttttttagctcagtcttagcatccttgagtgcctctaacttacccactttctggctactgaggtcactcagctgggaaaggtgcttgccttttgagtctgatgagctgagctcagtcccaggacccacatgcaggagggagagaacaggctcccacaaactgttctcgggcttccacgtgcacagtgtggcatgtgtattctccctcccaggtatataaatgtaatagatagacaaataattatccacttctaaccaggaccaatcgtgagagctactcaagatacaagaaggtagcaagttcagggccctcctgagctacagaaggaattcacagccagccgggaggactcagtgaaatgctgtctcaaaaggaaagaaaatgatttgatggtggggggagataatagatgaggagaacaattaagaacaaaatacactttacattactaaaatagtaattaagggaggtatattatgaataaagagaggcgcagtaacactgtgaggccctacagtttataataccaaaaataaaacaaaaataaaattaaactaaatatccactttcgtgactctgacctacatgcttgggatggcagcaccagtgtgtaaataaagaactggggtctaagtcaggtgtggaaatgacagtgagggcagcgtggagctgtgggaacctgtatgtcaaatgcacaaaagcacaaacacagctctcctcttccccgacatctcaaggcaacagtttatttctaaatttatgccagggctggagagatggctcagcagttaaaagtaccagctgctcttccagaggactgggtttgatccccagcatccacatggcagctcacaaccatctataaatccagcctcatgggatccactgcccttttctgaccttcacaggcaacaggcacacacatagtacacagacatatatgcaggcaaaacacccatacacatataataaatttatatatatatacacacacacatatatgtatgtatatatatatatagtacacatttgtatatatacacacatatacattatatgtgtatatgtgtctacccattatatgtgtgtgtagatagatagatagatagatagatagatagatagatagatagatagatgatagtgccttagaccagtcctacaaagcagtctatttcaatctttcaaaagagaaaagcaagtttgactggaaacattttgtttcccaggggaggatttggggccggtgagaagtgtctctaagggacaactgacaaagggctgaggtacagaaaaggaagaggagaaaggagccagggacgaggtgggaagggaagagaaaacagagacaatttgttcaaaagaaaaaaaaatgtaaagggaactgaaaagatggctcagtcagtgaagatcctgttgagcaagcaaggggacctgagttcagatctcagcactccataaacgcttggccttcacacatatattgcatacaagcacgtacacatacacatacatgaacacatacacacatacaccacatacacacacaccaatgaaagaatcaaatataaaagaggaagaaaggggtcttgagatatagctttagaaatttgaatattgggctggtgagatggctcagtgggtaagagcacccgactgctcttccgaaggtctgaagttcaaatcccagcaaccacatggtggctcacaaccatctgtaacaagatctgacgccctcttctggagtgtctgaagatagctacagtgtacttacatataataaataaataaatcttaaaaaaaaagaaatttgaatattgaaaagaacaaaaaacaaaacaagagaacaggctggacataatggcatatgcctttaatactagcactcaggaaacagagacaggtagatctctatgtaagcttcgggctagtctgggctacatgtgacttccaggctagcccgactgaagctacatattgagaagctggcacataaaaacaaagcaaaacacaaaagattggaaataccaacagaagcaaaacccaggcagcatctggggaggctgaagcaagaggaccacacatctgaagcctggtgtcttagttcctctgtggtaagacaccatgaccaagactactacctgtagaagaaagagtttagtgagacttacattgtcgggggtaagtgcatggccatcatggtggggagaatggcagcagtcaggcaagctggacactggagcagtagctgagagctcacatccttatctgaaagttggaggcagagggagttaactgggaatggtgtgggcttttgaaaccccaaagccgcctccagtgacatgcctcctccatcagagccacacccccaatccttcccaaacagtcccaccaaagaggaccaattattcaatcatgtaaatctatgggagccatcttcattcaaaacacagcatcaggttaggctataaagatcctgtctcaaaccagacagacagacagacaccccaaagacacaagggagcatagggaaaaagctgaagacaaaagatatattaaaataattgacaaatatcagttttctcctgttgctgtctagaaatcttttctaagccttgcctctctctctcctcctgtatagaatgataagaatttggaaccctccctagcccagcccacccaagctacggtcttaaggacaaggagaaatgggcagagacaaagtttgacctccagcattcctctgcgtggtttgccaacccctctgggtgtggacctgtgtgaagaccgaagcttgccgaagacacacctatcaaattaaatgcgcatagaccctatgagcctttgtaagagttgattttctccagttagtacagaatgctatggcaattggtgtggggcttttctttcctggtgggtcaactcttagcgtttccaatcttagagggagcaccctcataactcatccctgagcagtgccactcctgagctctggactctggccactcttgaacagctagctgcttgtgatagggcctcaccccaagaggacaggcaagagatggaagcatgtcccagctttctcaggaggactttggggacccaggcaaatgacaataagaaggcttggactggctctgtcctctgtggggacattcaagtctttgagatgttagttggtaggaaagcagggaggagaaacaggagcataggaggtagagagaggccaaggaagctatgccggaaggctgagggagggagaaggtagcaggtggcgtcttctcccttgatgatgtccctcctcaggcagcaaatgggtactctccggtgctgccatccccaagacatagatcctgggaaagccacaaaagcagcagtcagtgtgaagcccctgtgacagcacaggccttctatctggaactctgacagaggagcctggtgtccactcaatgatgcttcactgaacctctgctccatgatggaggcttagcagtggccacacacacacacacacacacacacacacacacacacacacacgataaatataaatacatccatcatctgtctttttaaatgttaattgtgccctcgtgtctgtctgacgtctggtcctctcgaaaggtatttttgttattatttgttcttaattgttcattgtggaaggcaatgctttaataaaatatatttggtggatagtgtcctttcttgtgttgggaggctcgcagtagtgagtctcacatatcccaggctggcttcgaacattttacacagcaggagatgacctgaaatttctgttcttcctacctctgcctcaccagagctgtctctgcatcgctagtgtggggtttacaggtgtgtgccaccatgcctggtgtatgtggttggtagggatgatactgggtatatcagggcttcatgcatgccaggcaagcaccctcgaaaacaagccagtcctagttcctagcacaagtctcatttcatgtttaaagattttttcttttaattttaaagtaggtgtagatgttttatttttttttttattttatatgtgcagatgtagttggctttgagggtcagaggcatcagacccccgagagctggagtcaaggcagatgtgagctgcctgattctgattcggatgctgagagctcaggtgctcagtacatattgcctactgccgaactgcaggagcagtaagtactcttcactgctgagccatctccctggctcccccttgagtctcattttaaacagaaaatgtgacttgacaccctggagtgacctgcccgacatttgctaccttcaccagggattttccatcacccaagacaacattttaacatgtcgtagaccatgttggcttctatccctcaaacacaactccatgacaagtgtccaggccgagggatcccagtcttggatccagggattggccaggccatcccagtggaggctgacttattctgagcacctatattggtaaactgtgcaattttagcttgttgagagtgtttgttttggcgatggaaagcggattaacgtagatgggacccagacgttcagataccagcacattcaagaaaaaaaaaaattatctgaatagatcaggaaaccattcctccctctggcggggttttcctaaccacaccttctaccctaagcactctggtgaggtacagcttccctccgttctagcttattgccacaggccagcaaatttcatggtcagtagatggcgctgtctcctataatttgcgggaaagtgcgactagcgctattctttcatagaggcttctttctgactgctgacttccttgcttgctttcttgctttttttttttttttttttgcttgttgtttgtttgagaacagggtcttacttgggaacatcacagccaagtataatcattgactttattttttaagcgggatagggggcaggggagaggggaagattgcgcacgcgcatgcatgtgagcgcatgctccagtaccccagcatgcatgtgaaggtcagagcacttgtttggggactcagttgtctctttccactgtgaacttaaggtattaaactcataattttcagactttccaggcaagtacttctgcccattgagccgtgtttgggcccttagtcagaatgaacgcagttgtggggatcaaactcaggccttcacatgctaaacaaacactgcacaactgagctgcggccccaacccactttgtagttgttgtgtttttattcttgtttttagccagggtcttactatatcaactgtggtatcctgccactttccatgcatgttcaggctggtcttgaacctgtgatagataagtcctacctctaactctagttgttgggatgtcaggcgtgtacctagactacaactagagtgcctggcttggctggattctgttgaaatatttgcatcctttttacttgggcattagagagccttcagtgtctcctttattggtcttctactataactgagtgttcttggtgctacgggttgaagctggtgcgtcagccattttcacgaagctctaactccattgtggggctacatccccagtactgagcaatgtcactgtcgcatcagtggtactgagtacaaccgtgtagataataaacagtttgtttgttgggcagtggtagcgcacacctttaatcccagcactcgggaggcagaggcaggcagatttctgagttcaaggccagcctggtctacaaagtgagtcccaggacagccagggctatacagagaaaccctgtctcaaaaaaccaaaataaataaataaataaataaataaataaaaactatttcatttagtggtaatttaaaaagagacataaagttatttacatggaaaaatccttcagttaagaaaacaaaaggctcccagtgcgaagtttctgtctttcatcagtttttatgaggtgagcaagggctgctggggcttttcatcagtttttatgaggtgagcaagggctgctggggcttttcagtgttgtccaggttatctgacttggcctcagctgacaaccctcaacacagaaagcaaggttagagaggagcccgggggagcctggagcaaatatagcgtctccacctcactgctgggacctactctcttccaatcaggggcagaggctcaggcaaaccaggcaaactgtcattctacaggcctgggaatcctttttcctgagctcatagtcacagccctggccagttccagaaagctctgttgcttctagatgaaaagcagccgcaacagccggcctattagagggcacttcccaggatccagggacacatcttagcggctcctgttgtgtaacctccttagcttctcggggtagttaggaactaggcagcattgtcactaatgctaagcgagcaggaagataacttgagcaagtcagaaagctactaaaaagcctggccaagatctgaacccaggcagtccgacttaagagtctgcatcatgaatgtcaaaattatccacctgggtaacatatgagacccacctctgagctggacagggttctgtatttcttgtgccttggtgacaggcgcagtagagaaatttcgggttgtattcccggagctcatgagcctttagttccaaagctgaacaatttttccattactaatgttcaaacttcacacaatcctctccctggtagttatgcatataaaatcatccacaacgggactagagagcttcgcaggggctgagacactgattgccctttacagaggacccagcatcttgtcttggcttgtctataactctgacttcaggggattcaataccctcttttgctctccacaggagccaggcatgcgcatgatgcatatacatacattcaggcaaaatatttaatcacataaagtaataaaataaaaattttaattgactataatgttcttgcttgttacatattatctcaggtctgactgaggaaggtccactctgtggggaccttccagctcttggatatactgtccctccacccactggccagtggtggtgtcctgctccttaatagtgatggaaagatctttgaaacttctttccttgaaacagcaatgcctccataagcccttgccaggaaggggcttctcagaggccatgcctctccatcccatctgaggtctctgctatgcaaaaagtcctctgtggtatttacattcacagaatgtaaagagcatgctagggcaaagagcgtcctggaacacaaaagcaaatcaatagagtcaaggcttaaaaaaaaggcatctttggggtttttgtcatttttgaaacagggttgaatgcacgtgcacgtatgtgtgttgtgtgctatggcacacacagctatggctatggtgttgtggaggtcagaggacagggagtcggttctttcctgccaccttagaagatcctgaggttgaactcaggtcgttagacctgtgcatgaggcctctaccaggtaagccatctccctggttccccacctccatttctcctcctcctcctcctcttccatatcttcaacagatttatttttaaaggaatggtctaagggcaaaaaagggctcagagtatggacaagaaataactacaaatgtaaataagctgttttatgaattcttttttaaccacagacacgtacagagaatgatgccccatacaaaacacaacggattcaaacaaggtgttctcttagcaaggctaaagattcagtctctggtacttggaatttaggatgcagtccccgtttttggatggatctctgggtatttggcacagtccatgcttttaaccagatttgaacagaagaatggccacctgacccaggtagaagtggatgaagtgttcggtttcatgcagtgccaggtggggttgtgctttttgtcaaactcctccttggtatgggccgaaatatccttttcggtgttgtacttctcaaatgcctaagtagcacactccgccgagtcctgttgcatctcttctaacatacctgcatttttgatcactgccttccggtcatgcatggttacattttactattgatctgggtcttaggaccccgtcctcatggctccagttcctccatcctgccgctgatctccacgtccattttcttagtggcatacaatcaccctctaaactattcacatttcaattccattgtggagcatctgccatttttcaaggacatttttttttcctgttattaacctaagcttacagaatgattacaagcagacgtctggacaatggacccacctgcatttttaaataatgtggcctctagttctttttgagacacagctctactaaagcttccatgctgtgattcggagtctcaccttctgcttctgtccaggaggggaaagcacagaggatcttgagagagaagctcttagctgtctggtcaggcctggcagtgccttggaaggcttagtcctgaggtgggagcccctcctctcccttagcttactgcccgtggccaagtgttgaaaggcattgtgttctctcaaaataaagattcaattgtggtttaggaatgaatgcctcaagaactgctgtaatgggagggccatcaatcccaaaaggcctggcttgccctgagtcacatgacttagaagcttcactagtggtcaaagacaaagccctagggaatcctttgctaatataaaattttatttattagccgggcatggtggcgcacgcctttaatcccagcactcgggaggcagaggcaggcggatttctgagttcgaggccagcctggtctacaaagtgagctccaggacagccagggctatacagagaaaccctgtctcgaaaaaccaaaaaaaaaaaaaaaaaaaaaaaaaaaaatttatttatttatttatttatttatttatttatttatttatttatttatgtgtgcatggctgcaggtgtgggatcccctgcagctagtgttacaggtggttaggagctcttcatcaacagggccagaatgcaaccacagtcttctctaagagcagcaagcactaattcactgggccatctgtctctccagctccaaagggactccagttatgtggacgttgtcacagtctcacaaaagatcagaaatcccattcaaaggggaggccgctatgagacagtaagattggggtcttggactgaggggaccttgacactgctatttatcctcaggtctctgagccccagggtctaatgaataaatgtttgaacttgttgagttgtatgagttcacacagtaaaggcttgagggggcccgatcctttgaggttctctgagagtggtggaaggtcagtctactgattcagctacttactcaagacggccatgagactaaggatactggtatacctacagggagaggagcttacttggcatgcctgaggctctgggctcaaaccctcctaatacccacagacacatgacatcagctttctccctttctctgtatatttgtttccatttattttaccttttttattgaagtaactggaaaatagtctgcacccttcaggcactgtgagaaaaaaatctagagaaataaaaattatgactattttgactgctttgttggattggacaagggagattggataaaaactccagctgagatttcctctaggttaaaggcctgttgacaattaaataacaaaaggggggctggagagatggctcagcgggttaagaccactgactgcttttccagagggtcaattcccagcaaccatacggtgggtcacaaccatctgtaatgggatctgatgccctcttctgatgtgtctgaagacagtgacagtggagtcacatacataaattaaataaataaaataaatattttctttcttcttaaaaatatttatttatttatttcttgtatatgagtgcactgtagctatacagatggttgtgggccttcatgtggttgttgggaattaaattttaggacttctgcttgctggccaaccccacgcgctctggtcagcccccactcactccggcccaaagatgtatttattattatagataagtacactgttgctgtcttcagacacaccagaagagagtgtacgttctcattaccagtggttgtgagccaccctgtgcttgcagggatttgaactcaggactttcagaagaatagtcagtgctcttaaccactgagccatctttccagtccaaaaagatctttttttgggtgtgtgctttggagagctaactttcaatatgtgttggtgtttcgcctgcatatatatctgtgcaccacatacatgtcgggcctgtggaggtcagaagaggatgttggattccctggtactgagttacagttgctaactgccgtgtcggtgatgggaaccaaacctggatcctctgcaagagcagcacgcggccttaaccactgggccatctctccagccctttattcccactcctttgtttgttccaaaggaaggagagagagagagagagagagagagagagagagagagagagacattagcttatttttattctagtgtaagggtattttgttgtcatgtatgtccctgtgtggtatgcatgcaaatgtctatagagttcaagaggctgtcagaacctcagacaggtgtgagctgccatgtgaaccgtgatcatctagaagagagaccatttattttcgccaccaaccccctaactaatggtaaaaaacacataatgtaaaatttaccattgtggccattttaagaggaccattctgtgccaataatactatccatttctagaactttcccattattccaacttgaaactctgtactcagaaataaaatccccttctctcctcccaccagcctgtcagcctgtggtaacatctgttttacctccttctatcacacttttggttctagacatgttacacagtagaatgtctgggcatgacagcacacccctggaatctggaatcttaacactcaggaggtacaggcaagagaatcaagaattcaatggcatcgtcttcagctacagagagttcaaggccagcttgggctggataagagcacccacacacatcccacacacacacacagacacacagagagagagggggagggagagagagagggagagagagagagagagagagacagagggagagaattatataatatttgttcccttgggtctatttcatgtcacacagggtgtttttaattttgtagtaagtgtcagaattccattcctttgttttgttttctcctgattttgagacaggttctctctgcatagctctggttgtcttggaattcattatgtataccccctagcctcaaatttatagatctgctccctagcgctgggattaaaggtgtgccctcgtacccaggtccgtttcattttaagatcaaatagatcatcacgtgtaactgacactttttatctgtgagcacttagatgaaggactcttgggagggggacacaaaccacaaagcagaaattctgaattagaaaaggcatcaacaaaccagctttaatgcagcttagattgctcaggactgcttacagcaggtctgggcaggctggggacccagagaaccaccagataagacagaaggggtctggtaagaattagggcaagttggatcacagcactttccaggtgcaatttagataaatggtggtccgtgccagatgtgggacaaagtaggatatttcagccgctacaaagtgctcattttgagtgcagagaagatgggatactatgggccctgaactcaaagaatgcatggcataggaaagccaccattgtacttaaagcagtatttcaccttctagctcatcctacactttcctgccagaccaagcaacactccagttcaaactctttgatcagctcccataatgtagtagccacctctaagctgggataagcatagccccaaggctattgccctaagggccaggtaattccaagatctacctgggctgtttctgcagcatgaattcttttttttttttttttttcttttggttttttgaggcagggtttctctgtatagatagccctgactgtcctagaactcactttgtagaccaggctggcctcgaactcagaaatctgcctgcctttacctcccgagtgcgccaccacgcttggcatgcagcatgaattctactggataatggttagcagcaaacatgattttttttcgagacagggtttctctgtgtagccctagctgtcctggaactcactctgtagaccaggccggcctcgaactcagaaatctgcctgcctctgcctcctgagtgctgggattaaaggcgtgcaccaccacacccggccaaatatgacttttaagtcataacaaagcaatgtaggacagagtacgaatttgcatatggtccaaggatgaactttgaagtttgctctggattggttcacttttccctatgcacacactacaaactggctcctgtcagtgccacccagttaagagtttgaaaggtggacacaacaaagtttttaagattcaaacgccttaggtaggtttttgcacctacaccgccaagtcctgaccttctagctgctgctgctgctgcttctgctgcttcttcttcttcttcttcctcttcctcttcctcctcctccttctttttcttcttcttttatttatttattttttcttttggttttttcgaggcagggtttctctgtgtagccctggctgtcctggaactcactctgtagaccaggctggcctcaaactcagaaatctgactgcccctgcctcccaagtgccgtgtaaagtcgtgtgccaccatgcccagctccagctggttcttaataggcaaaggttaggctgccttacttaaatctggatttcagggaaaaagctagcagtcgcttcctccagtatattaacccttggtggctcagtttgctcacctaaacaacgggagggatgttagcacttatcacagtgcctgctcaccagggtgccctccgcttcacctgaacttccacgttccacgtgtcctcccctgcccatcccaagcgtggcgtctggattgaatattctcgggcgaggcctggcctggcatgcgcttgtggcatgacgaaatggcctgacagatccaagccgtaactgccccacgatcctgaagtcaaaactgagattgctttggcccaagtaatctctgcaggcctaatggagcgcgccccgccccctcccaactccaagaccggggagggagaccctaactagaagtttcgaacacccgatccccacaagtgggtcagctgtgacagccacctgggcaacccaggatctaggcgtgctggcgggtcccggtgcagggcggagctggtccggcccgagctcgccccgccccgtcccgcctagccgtaaactgaccgagtggcggcccgcaggagaggggggaggagaaagcagagaagagtgggggctggcggccgaggaaaaagggaagggtctccgagagtagacgcgcgggggactcggcgagggtgcgtccggagcagcgacaactccgagcgtcccagcgggccagcgaggaggatggtggcggccgggcgcggaccagcccggccgcgggcgccgtgagccggagcgcagcgcccggcatgcggctgcggtccccggcctcggccccgctccgc

SEQ ID NO: 2 - DNA, 2969 bp, Mus musculus
cacatggtgaagggtcaagaatcaacccttcccaccatcctctggcagctacatgagcactgtggtgtgcacacacaaaataagaaggggtcagagttaatgagtggacttcggacttgaaagacagttaaaactccaggcagcgaaggagaggacacatttcctccttggattatcaagcaagagcagctaccatgaaaggcttcctgcttctctctctcagtctccttttggtgaccgtgggtagttcatctcaggcctctagtacaacatcgtcttctggtggcaccagtcctcccaccacagtacaaagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggcctctactacaacatcgtcttctggtggcgccagtcctcccaccacggtacagagtcaatctccaggtagttcatctcaggtctctactacaacatcgtcttctggtggcgccagtcctcccaccacggtacagagtcaatctccaggtagttcatctcagcccggaccaactcagccttctggtggtgccagctcttccaccgtgcctagcggtggaagcacaggtcccagtgatctctgcaaccctaacccctgtaaaggaactgcttcttgtgttaagctgcatagcaaacacttctgcttgtgtttagaaggctattactacaactcgtctctgtcgtcatgtgtgaaaggaacgacattccctggggacattagcatgagtgtgtctgaaacagccaacttggaagatgaaaactctgtgggctatcaagagttgtacaacagtgttaccgatttttttgaaacaacatttaataagactgactatggacagactgtaattattaaagtgagcacagccccttcacggtcagcaagatctgcaatgcgtgatgctacaaaggacgtcagtgtatccgtagtaaatatatttggagcagacacaaaagaaactgaaaagagtgtatcttctgcaatcgaaactgcaattaagactagtggcaatgtgaaagactatgtcagtataaatttgtgtgatcattatggttgtgtagggaatgacagcagtaaatgccaggacattttacaatgcacgtgcaaacctgggctggacaggctgaacccacaggttcctttttgtgttgctgtaacgtgctctcagccctgcaatgcagaggagaaggagcagtgcttaaagatggataacggagtaatggattgtgtgtgcatgccgggctaccagagggcaaacgggaacaggaagtgtgaagagtgtccatttggctacagcgggatgaattgcaaagaccaatttcagctgatcctcaccatcgtgggcaccattgctggagccctcatcctcatcttgctgattgcttttatcgtctctgcgaggtcaaagaacaaaaagaaggatggagaagagcagaggctgattgaggatgacttccataacctacgactgaggcagaccggcttctccaacttaggagcggacaacagcatcttccccaaagtcagaacaggggtcccgagtcagacccctaatccctacgcaaaccagcgaagcatgcctcgccctgactactagaatgataagaatttggaaccctccctagcccagcccacccaagctacggtcttaaggacaaggagaaatgggcagagacaaagtttgacctccagcattcctctgcgtggtttgccaacccctctgggtgtggacctgtgtgaagaccgaagcttgccgaagacacacctatcaaattaaatgcgcatagaccctatgagcctttgtaagagttgattttctccagttagtacagaatgctatggcaattggtgtggggcttttctttcctggtgggtcaactcttagcgtttccaatcttagagggagcaccctcataactcatccctgagcagtgccactcctgagctctggactctggccactcttgaacagctagctgcttgtgatagggcctcaccccaagaggacaggcaagagatggaagcatgtcccagctttctcaggaggactttggggacccaggcaaatgacaataagaaggcttggactggctctgtcctctgtggggacattcaagtctttgagatgttagttggtaggaaagcagggaggagaaacaggagcataggaggtagagagaggccaaggaagctatgccggaaggctgagggagggagaaggtagcaggtggcgtcttctcccttgatgatgtccctcctcaggcagcaaatgggtactctccggtgctgccatccccaagacatagatcctgggaaagccacaaaagcagcagtcagtgtgaagcccctgtgacagcacaggccttctatctggaactctgacagaggagcctggtgtccactcaatgatgcttcactgaacctctgctccatgatggaggcttagcagtggccacacacacacacacacacacacacacacacacacacacacacgataaatataaatacatccatcatctgtctttttaaatgttaattgtgccctcgtgtctgtctgacgtctggtcctctcgaaaggtatttttgttattatttgttcttaattgttcattgtggaaggcaatgctttaataaaatatatttggtg

SEQ ID NO: 3 - protein, 580 aa, Mus musculus
NSRQRRRGHSLDYQARAATMKGFLLLSLSLLLVTVGSSSQASSTTSSSGGTSPPTTVQSQSPGSSSQASTTTSSSGGDPTTVQSQSPGSSSQASTTTSSSGGDPTTVQSQSPGSSSQASTTTSSSGGDPTTVQSQSPGSSSQASTTTSSSGGDPTTVQSQSPGSSSQASTTTSSSGGDPTTVQSQSPGSSSQVSTTTSSSGGDPTTVQSQSPGSSSQPGPTQPSGGASSSTVPSGGSTGPSDLCNPNPCKGTASCVKLHSKHFCLCLEGYYYNSSLSSCVKGTTFPGDISMSVSETANLEDENSVGYQELYNSVTDFFETTFNKTDYGQTVIIKVSTAPSRSARSAMRDATKDVSVSVVNIFGADTKETEKSVSSAIETAIKTSGNVKDYVSINLCDHYGCVGNDSSKCQDILQCTCKPGLDRLNPQVPFCVAVTCSQPCNAEEKEQCLKMDNGVMDCVCMPGYQRANGNRKCEECPFGYSGMNCKDQFQLILTIVGTIAGALILILLIAFIVSARSKNKKKDGEEQRLIEDDFHNLRLRQTGFSNLGADNSIFPKVRTGVPSQTPNPYANQRSMPRPDY

SEQ ID NO: 4 - DNA, 49175 bp, Homo sapiens
  misc_feature (1)...(49175): n = A,T,C or G
ttcaattttctcttttattagcatgttgtgacatttttcatgtggtagaaaatgtgtatttcttttttagttaactcacctgtttgcttctctgctctcacactttcgaaggccctcttccttgccattcaccctacggtgtgccctagcacagtgttttccaaacctgtcggttttgtacctccctcatgatttttgacaaatcatgtattatcactacactttcttacatatttttgttgaaattgaccttttttaaaaaaataattaactgaattttctttttctttttcttttttttttttttgagacattgtctggctctgtcacctaggctggagtgcagtggcacgatatagctcactgcagcctcagccttgaactcctgggttcaagcgaccctactgcttcagactcctgagtaactggaactacaggcatgtgccaccatgcttggctaatttttataaccttttttgtagagatgggggtctcaccatcttgcccaggctggtctcaaactcctggcctcaagtgatcctcctgcactggtcttccaaagctctgggattatagtcatgagccaatgtgccaggccaaacttaattttaaaataaactttacagcttggtgtggtggttcacacctgtaatctcagcgctttgggaggccaagatggaggatcacttgagcctaggagtttgagacgagcttgggcaagatgctgagaccctgtctctatgaaaaaaaaaaaaatttttttctgatttagccaagcatggtggtacatgcctgtagttccagctactcaggaggctgaggcgggaggctcacttgagcccagcagtttgaggctgcagtgagctgtgacggtgccactgttctccagcttgggtgatagagcaaggccctgtctccagaaaatagataaataaataaaagcaaattaactttacatcaccaccccaaatttagaagaaaaaaaaactagtttcctttgccatggatagaaaatagccataagaaacataaacaaaaataaagtgttattagattaccaggagtttggttgccaaaggctctgtgtctggggcctgagctctcttcctcacaaagagaaatacgtaattattagagaagagttaaagatatcttagcaatacatgagattttctcattgtgtaatcagaatgactgaaatttgaaaaggcataactttcccctccaagtgaatcactgttatctaacgctgtgtccatggacacttaaaatcatcttgtgtgccacgaaggcagtggtcctcagagctgagcaccagcagagtcacactaaaaatacaaaaattatccaggtgtggtggcacatgcctgtaatcccagctactcaggaggctgaggcaggagaatcacttgaacctgggaggccgaggttgcagtgagctgagatcatgccattgcactccatcctgggcaacaagagtgaaactccatctcaaaacaaaacaaacaaacaaacaaacaaacaaacacagattgctgattcagtaggcctaggtggggcctgagaatatgcatttctaaaatgtttccaggtcatgctggtgctgctggtctggggaacacatttttgaggactgatgccctagttgtatcatctctcattttaggaataactggactgggtaaggctgagaggtacaaaccccaaagaggggcaaacctactcccacccattgttttcagttttcctcagagcaacaagtccaggcctggtgctagcatctctgaggacaatgttttaatctctggaaccactcgcttcctctctgaagagatctgaattacaatttgtggccaccgcaagagctttctgatctcagtcaaacctcccatagtcttgatgggtgagtagaggaggaagtgggtgagaaatcaaactccttcctggggaaaatctctttatagaacttctccaagagttaaaaaacaaaagataataaaatgaaataaaataacaaaataagaagcccacaaaatctctcatgatgtgaaatttatttttagagctgactaaactcagtgaggtgagtagataagcaattgtgaaattttataagccaagactcaaaaagccaatgcctgctccttttgaaggtcagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggttgcagtgagcagagattgcaccactgcactgcagcctgggcgacagagtgagaccctgtctctcaaagaaaaagaaaatctatacattcgtacttgaccctttctctgagcccattacatcgtgggtgtaagaagtggaagtagccatgagagtgctcgaccgccgtcctgccacccaacaaagcaagtcattttcatgtgttcgtgtttcctgccagcgcttatctttaaggaggcaaattatggaggcatggtttttacataattagagatataatgagaatcctgcctcttcaacttctattgtagtagaataagcacttccccataagcacttcccctcacggctgcggtcttctgcatcgtaccgtgtgtggatagagtcctacctctcatcaagggtggtcaccacatttaaacctctgttgttgggtaaggttgttttcaattatttatactgtatatatgtaatactgcagcaaacatatctgtacatataattttcccttcatttgaaattattccttgaccaggcactgtggctcacgcctgtaatcccagcacttcgggaagccgaggcaggaagattgcttgaggccagagttcaagacccccgtctctacaaaacttaaaaaaaagatttttttgaagaaattatttaagataaagttccagaagtaaatttctcagtcacagggtaaaaacttttttgtttgtttgtttgtttgttttttaagacagggtctggctctgtcacccaggctacagtgcaatggcacaatcacagctcactgcagcctcaacctcctcccaccggctcatgaggctcaagcaatcctcccaccacagcctcctgagtagctgggaccacaggcatgcaacaccatgctcgactaattttttaattttttgtagagatggtgtctcactgtattgcccaggctggtctcaaactcatggacttaagtgatcctcccacactggcctctcaaaatcatgcccagccaagaacatttttaaattgctcttaatacctgttgccaaattgtagcatattacaacgtagcaattgtaaagcatattgaattatttgcacccccaccagagttggagatatcattgtacacatttttaaaagatgtaaaatattacaccagtgtggtggctcacacctgtaatcccagcactttgggaggccgaggcaggtgggtcactagaggtcaggagttcgagaccaacctggccaatttggtgaaacccatctctactaaaaatacaaaaattagccaggtggggtggtgtgcacctgtaatcccagctactcagtaggctgaggcaggagaattgcttgaacctggtaggtggaggttgcagtgagcagagatcatgccactgcacactagcctgggtggcacagtgagactccatctcaaaaaaaaaaaaattaaaataaaaaaaaagaggtaaaatataatctcacttttgttttagttgtaacatctttaagatgagtaaaggccgggcacagtggctcacacctatgatcccagcgctttgggaggccgaggcgggtggatcacgaggtcaggacattgagaccatcctggctaacacggtgaaaccccatctctactaaaaaataaaaataaaaaaattagccaggtgtggtggcgggcgcctgtaatcccagctactcgagaggctgaggcaggagaatggcatgaacccaggaggcggagcttgcagtgagccgagattgcgccactgcactccagcctgggtgacaaagcgagactccctctcaaaacaaacaaacaaacaaaaaaagatgagtaaaaagctaaatattcttcccccacatatttacttactaataatattttctcttttgaataatttgatcatgacaaccaacttttggaagataaattgtctgaatgcactgtgggtctgaagaccccaaactgtgtcttatttctttgcattccctgttccctgcacctagaacaaatcggacggccttcattcattccttcctttcttccataaatctttactgagcacctgccatgtgccagctgttctggatgctggagacagaggagtggacagggaagagaaactctcatggaagttaggcaacaggtagctaaaccagcaaagagacaaagtaattacatattgtgatgagggctatggaggaaacgaactgaggtgggatggtcaggcgagtagaccagctcctttagataaggcccccaaggaagatctggcctgtcgttctcctgcttaaatgttcccatggcttctgccattgtgcttagaataaaatccacattcctttccacagcctctaagatcctgtaggatcaggccccagcctgcctctctgacaacatctccccccagtctcctcctaaatcatggtgctcttcaaacacaccagacttgttctggcctcaggcctttgcacttactacttttctagctggaatgccctttttctgatgtttatatggcaggcttcccttcaatagcagctctcagttccgatatcagctcctgcaagaaggttttgctgaccatcctatttaaagtagcacctcataccccacaagtcactatcccattgttgtgttttattttcttcagagcattgaccactctctaaaatcattgtatttaattactttttttgccgacctccactacccatgatctcacagaagcttcaggagagcagagaccttcatcatcttgttcactgcttcatcttcgatacctgatggatgtgcagagatgcctcgagtacctgggagtgactgaacagccccctcctgaacattactcatgtaaagcaaccattcactgaaaagttaatttcagagggtataaaaagcaagagtggaaatggttctgtcaatgtgtcatcaattagacatttgagttgggaatattgcattccacaagtcatttctctgggaatggtcttctgaattagagaggaaaatgctgatcagcttcatgtagtatctaaatgtgatatccgtaaatggtagtagtgactctgggaaggctatactcacacctctattgaggggctggaattagtgagaaggagataggagcttaacatgtatttacatttggttctatagacagaaaataatctttgggtctaactatttaatcttgatagaattttatgttttaatgatcctctagagccttatcatggtactgcagtgttgcagaatcaaagtagccaaagaggagctcttttgtttgagacagggtctcgctctctcgcccatgccgtggtgcagcagtgcaatctcggatcactgcaacctccgcctccagggttcaagggatcctcctgcctcagcctcccaagtatctggtactacaggcatgcattaccatgttaagataattattttaaaattgttttgtagagacaaggtctcactatattgcttaggctggtctcaaactcctgggctcaagcaaccctcccactttggcctcccaaagtgctgggattacagatgtgagccacctcacctggctagagaggctcttgatggatcaaattctaattctaaatggctctgatatagctctcttgagtttatgcctaaataactggatattgctttagattaatgggcatgtcccattcctctgcatagtcaatagaattattgaaaagctcaccctgaacaatagttcttttgcaaccaggtaattatgggtaaacagctttttttttttagctgacttggtgacaacgttaccaacatataacattgtttctgtgggaaaatggagtctgtgttcttgacttatagataaatacttagaatttagccatttcatactaataaatatcaaccctttttcctatccaggttttgagttctgtgagaagtaaaacacagagtacaacagatggagacaaaatattacttttatagaagcttatttttgagaatgtggcttagggctccctccttctggatccttaccttcttgggcacaacaatcctgaatccaggttatctccccaaatggaaactgcaggatctgaggtgagtattcccagtttattctgaaataagtcactactcttcctttagggcaaaatgaataaagacatgccaagaggccaggagtgtttcaggaattaaactccctccattagtgaggaaacatcagccctgaggaagaagcagtttccctcatgaaagctctgtgtattgtctctgtcatcctgcagtactgaagtcctgtgtggatgctttaggagcgggcataccggtgattgctgatttatactttgaggactgcctgactttctggctgcccatatttttccagatgataaggccagggaagagtcagggagccagatgcttggcagtactccatgccttcctggttatacttttcattctatgctcagcagataagtaatatagaaaaccatggaaatattgacactgttgtaatatggtggcatcagtagacattagtgatagagcactgtgggcgctactcacttgatatcttgaatctaagacatgatggggtgtgataggcttctcccagtttaggagacaggatttgagaccctgcatttgagatcctgcagctacttatgtgaccccaggccactttttcaatttttctagattcctggttaggcttttataaagtgaatatagtaagtttaaaatgccatataaaaatgacagaaaaggagaaaagatttgcaatacatatgtaaagaacttttaccattaaaaaccaagaagaaaaccaattcaacgatacaatgtgcaaattatttgaacaggtactttacaaaagaagagacacgagtgactaatatgcacataaaatgatgttcaacatcatttgtcatcaggagatgcaaattaaaacaaaagtgagatgccactacataccctttagggtagctaatataaagacggacaataccaagtgttggcaaggatagggaacaactggaattctcatatattgctgatgtaaaatggcataacaacttaggaaaaccatttgaccatttattaaaaagttatatagctaccatgtgatgcagccattccattctaaatatttaccctaaagaaatgaaagtgtatgttcatacaaaaacttgtacatgaatacttataacttttttttttttctcgagatgaagtcccgctctgttgcccaggctggagtgcagtgacgtgatcttggctcactgcaaataatacttccggggttcaagggattctcctgcctcaacctcctgagtagctggggttacaggtgcctgccaccatgcctggctaatttttgtatttttagtacagatgaggtttcgccacattggccaggctgatctccagctcctgatctcaggtgatccacctgcctcagcttcccaaagtgctgggattacaggtatgaaccaccacacctggccttatttataatctttttgtttgtaatagtcaaaactagaaacagctcaaatgtccatcgacagatgaattaccaaacacgccatggtacattgatacagtggaatagtgttcagatataagaagaaacaaactatgaattcacacagcaaggatgagtctcaaaatggttataagtgaaagaaactggctcaaaaaacaaaacaaaacaaaaaactacatctgtatgattccatttacataaaatgctagaaaatgcagactaatttatagagacagaaagcagatcaatggttacctggggttggggtggagtataggggatgtagcactaaaaagggacaagaggaaagtcccaaagggtgtgttgggaatgctcggtatcttggttgcaacggtagctacacatgtatatacatcaatcaaaattcgttgaactgtacactgtaaatagatacagtttattgacataaattatagctcaataaagctagtttaaaaagaaaagaaaaacaaggctttgtttaaatcctgatgccaggagttattcaagctgagaataatagcataacataatgggccttagaagtgtctttgctttggaaaaagtgtttaaatggacctctcagccatgtaagaacaaacccctgtcttattcttgaatggagactctaggacaataagcagcttatctgctgggcgatcatacaaaaatgttttgttttcatcaaggtcagggttaaaatttaaacccaaaggccaggtatggtggcacacgcttgtaatcacagcactttgggaggctgtggttggggattgcttgagtctaagagtttgagaccagcctggacaacatgacaaaaccccatctcttctgaaaatacaaaaatcagccaagcattgtggtgtatgcctgtaatcccagctacttgggtgactgaggcaggaggatcacttgagccctggaggcagaggttgcagtgagctgagatcgtgccactgcacttcagcctgggcgacagagtgagactctgtctcaaaaaaaaaaaaaaaaaaaaaaaaacttaaactcaaaactctagccacaactcacaaggtatcattagtttatattcctctggctggggctagacacagtagagttggggccctggactttaaggagggaaaattagattaagaagacccaaatccaagcagtaaagctggttcctgacacatggtgagaggtgaggggctgaggaactagagagagggtgagaaagggaactgagaagtggggcctgcccaatgagtggccaggagcagagagatcaaatcagctgttctaagttttctcttttctgtactttattgccaactccccaacacaccagtcacccacaagacttcagtaaagttaggttaaatgccatgatgtgatgtccattgtgcttgggaactttattgggggctgtatccaggtagagtcacagaagcttggagatgtgattacaaagttgctagacatgaccatcagagaggcccggaatggtagtccccagcatacagtgacaaaagttaagcaactaataattttgggaaacatgtaagtcctcttcagggattctcagaactacagctggaggaaagtggtttcctgcactcatatgtgggtgagtagagcacagtttgttattgaatgtttaatggaatggtgacctcctaaaagatggcagcttggagacatttgagatatcaagagattaaccaaactcatgtgccaccaacctcacaaggatatttggaatgtcctgacttattttgggctttgagtcagaaaaatgattcgtaaggccagctccacctcttctatctcaaaagctcggaagagacctatggtatttggccaaatgctagctataattgcctttctgtggtttgacgtcaattaatgactggactttgtacccgaaagacagttaaaacgaaaggtagccaggaagggaaatcatttcctcctcagattaccaagcaagaacagctaaaatgaaagccatcattcatcttactcttcttgctctcctttctgtaaacacaggtaaggaatatttttacattttaattcttccaatcatgtatgttgtctttgaggtagaatcagcaggcctatagctaccaattctcccagcccagcacatggtctattttataaatgaagtttcctctccagctcagctcaaagacacagacattttatcctgtgatggggaagatagagcaatagcaaaagtggtctgtgggctgggcgcggtggctcacgcctgtaatctcagcaatatgggaggccgaggcagatggatcacttgaggtcaggagtttgaaaccaccccggccaacatggtgaaactccatctctactaaaaatacaaaaaaattagccaggtgtggcggtgggcacctgtagtctcagctactcaggaggctgaggcagaaagaatcgcttgaactcgggaagtggaggttgcagtgagctgagatgacacggagtgacagagcgagactccatcttgtaggggtggggggaagaagtggtctatggagtgagatctgggggctcagcaaaccagaggtttctctttgagagttcctgaggccagataagaaggactaagtaggttgcaaggacccagttctctactatagcgttctggatcccctctcatgataatcagagagctgaccacagcaaaaagcctcctttcacaaatgtacttgaatttgagaatgctaaaccatagggagtaattgtcacgttgattagacttcagacatgtactctctgttctgagttaggaagggttctatgggccacatgtgggtgaggtcagcagtatgttgagaggtgagggttgtggaggccaattggcttcctaaaattttgcagaaaaatcacggaaatgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaagggtcagctcaggggtggtttccttctcggtcttctttcctgtagtggataatgacataacagggaggggaacaggagcaatagttcttctttggtggatcagtccttacagcgcttgttgacctctaagagtttttaatttaaaatactcattatatcatggagctatatttgggggtgaaatatttttatttccttcaggttcaatgagttgaaatctagaagctgcttgcagaaaggaagaaagtatttgataaggcagatgtatgaagagaaattaagccctttcagagaactggaatgaatggcatcaggattagagttttttgagagctggtttcaagctcttaatgctggaaggttggagaaggctagctgcacaggaggggagggctcaccagatctctcctgccaaccttgggggcagatgctaggtccaagccttcaggacaaaggaagaattggtgaggcttgtatgactttcaggagccactgttaaaaaaggcttgactttttaaaaatagaatagaagggcggtagaaaggggaaagttggctgggaggggacaaggagatgaatagagagttaagggaatcaggaatcattgaggctcaagggaccttaggggaatggagatgtttcttgacccagagaacccagggggaagggcaaaagtagggcaagcagggattcagatggcatgccaccacttattagctgtggggtgtctctgaccctcagtgtcttcctgtgtagcaatagaggggaaatccctatactgaagagtgactgagaggattaaatgagacaaagagcctgatgtgccgggatactgcctggcacataggggcttaataaatgatttccctttttgtcatgtctgcacttggatctgattttcttttctttctttctttttttttttttgagaccgagtttcactcttgtcgcccaggctggagtgcaatggcacgatctctgcttactgcaacctccgcctcccaggttcaagcgattctcctgcctcagcctccagactagctgggattacaggcacctgccaccacacctggctaatttttgtatttttagtagagatggggtttcaccatgttggctaggctggtctcagactcttgacctcaggagatccacctgccttggcctcccaaagtgctgggattacaggcgtgagccaccacgcccagcctggatctgattttcaaactttggttttgatttcctcttctttgtttaaaaaagttatacaagtaatgcagacccactgtaacaaatccaaacaatacagatgtatatgaaataaaaattgagcatccaatctgacttcccacccatctacctccagatatattaatactgacagttttgtggctactaaggtttgcttttgaaaaaaatatttattttattatttatttatttattttgagacagagttttgttcttgttgcccaggctggagtgcaatggcgccatcttggctcactgcaacctccgcctgccaggttcaagcaattctcctgcctcagcttcccaagtagctgggattacaggtgctcactaccacacctggctaatttttttgtatttttagtagagacggggtttcactacattggccaggctgttctcgaactcctgaccttgtgatccgcccgccttggcctcccaaagttctgggattacaggcgtgagccaccgcgcctggccttatattactttttgagatggagttttgctcttgtcgcccaggctggagtgcaatggcactatctcagctcactgcaacctctgcctcccaggttcaagtgattctcctgcctcagtttcccgagtggctgggattataggtgcctgccaccacgcccagctaatttttgcatttttggtagagatggcgtttcatcatgttggccaggctgatcccaaactcctgacctcaggtgatctgcccgcctcggcctcccaaactgctgggattacaggcatgagccaccgcgcctggcctgaaaatttttaaaaagttgcttttttttttttttgagacagagtctcgctctgttgccaggctggagtgcagttgtcacgatcttggctcgctgcaacctctgcctcctgggttcaaccaattctcctgtctcagcctcccaagtagttgggactacaggcgtgtgccaccatgcccagataatttttgtatttttagtagagacagggtttcatcatgttggccaggatggtcacaatctcttgatctcatgatccacccacctcagcctcccgaagtgccgggattacagacatgagccaccgctcctggcctgaaaatttttaaaaagttgctttttaatgtaacgttaaggattttggaggtgtgtgtaaggaatcactacttcaaacatgagttccatctcagattctgagcaaccaagggcaggaagtgtgtcttgtacacctttacgttcctcctcacccctatgccttgtatagcaccttgactgcaagaacccccgcacaagcatttactgaaacaaatgaaaaatgtgccagtgacatttgaagagcctttaacaggcaaaacttcccaggttgtttttgctttctctgagagactaggactgcattattccacagaatctgatgagtgcctttgggaaccaacatctcatcataatgaagaattcagatctgggagaaaggcgtttgattgtgactttcagctagctttgaataaagcagttataggtgtgccctggacaggggtggtgattatggagtgttccccagaaagaaaccaagtcagggcatatattttcccattgaaacctatgatttgtacctctgtggacgttgtgctatccttgtgttatttagaagctttaggacctaaggaaataaaaagactaaagttatttctactgcacagatgtcttcatatatttctgttatctatagattgaacaaaataggttattttacagttcctcttgggtatttttactagataatttaagcctgggatatcagctctaagctgtcttccctgaaatctatacaaccctcagataaaacacatatatacacatagacacacacaagtgtattttagtttaaaaaaaatcgtagctattcacagcaatgaattgctgtcagcttggaatgtgtctcatttattaaaactaattgagcattctgaaatgtattctccctagtgaacagaaatttaaaaccaaaataaacaagccaccaagtccaaaactccttgtcataattccaaagacctgcaaaaacctctcaagaagtcccaatttgttttatgcacatctacagaaacatgttggttctttggcatcggccgagaatgaatattcccaaagcatgaaattcagggtctggtggggttggggttgtttgcacccacagtctgccaagtccttttcttctgtccagagttttccacagcgagagccagcccctggccactctcactgctaccccgatgatagagggcaccgtggaggtcacttctatttccaccgctttcattctgatccccaattttctctatttgcttttcttgtgtttgttcctcgggggtcttggctttttcgttaaatggatggccttccccataactttaatcaagtgatagttaggacattgtcatctcacagacctggctttgcctctgggcaaattccttaacccttctgagtattggtgggctcttctgtcaaatgtgggcacttatgtctacttcacaggtacagtcgggcacagggccagtgcttgatagatgagaactatcctgagtggcaggaataggaagactggcagtcaacattgccagctgctgatgtatttcttacctaggaagagcaattgctgatctcttcaacacttctgaatggctatgttagccaagccctcttcaaggtgaagaatcaggctctgccctcaaggggctcatagacccatcggggaatcaggaagcatattctgcagttctctgcaccctaaggtttagaaattgcttcctcactaaacctttttctttcaataatttttttaacctattgtcaaggtcagagttcttagagacaaggaaaagttctagaaaacttatcactgggccaggcaaggtggcttacacctgttatcctaacacttgggcggccaaggtgggaggatcacttgagcccaggagtttcagcgctgcagtgagctattatggcaccactgcactccagcatgtgtgacagaacaagaccatgtctctaaaaaaaaaaaataaaataaaagagtgggggaagaaaatggatcactggatccctagagtttactactccatgtgtccaggggttcctaaaagttgtgaaaatgcgactttgatatccatcatagctcagagggcaaagatcacttattcatcttactcttagtcaatgtatctagaattgtgaatgggaaaacactactagaataaaattttggaagaagtataataagcacttaatgaggtatttttattttattattctttaaattacccaaccctaacctttccctccctcaatctatcaaggtaatgaaaaaatgggacagttgccttaaagtgcagaaagacaaaaggagtccatttctgggtagtcactgcgccaccttgtggcattctcaattgtcctcactgagaatggtctgaagtatattaaaccctgatctacagttacgtgactacaggcataaataatattacttcttagtactcaacttaaaaaacattaactcttctgcgggactggtgggtcacatctgcaatcccagcactttgggaggctgaggcaggaggatcatttgaggccaggagttaagagaccagcctagccagcatagtgagaccctcatctctaaaacacacaaaaaaattagccagccatggaggtgttacaactgtagtcctagctatttgggaggctgaggtgggaggattgcttgagcctaggagctcaaggctgcagtgaactatgatcacaccactgcactccagcctgggtggcagagcaagaccttatttctaaaataaataaataaacattaactctttatttgtcacatttttcaataacattttttccagttttgtctgtttaatttttaatgttatttattgtgggttttttgtgtttagaaataaccatgtattttaatttttaatgtagtcatatattttcatttttccagaaaagaatgagttgaggctgggcatggcacttcatacctataatctcagcactttgggaggccaaggagggtggactgcttgagcccaggggtttatgaccaatctaggcaacttggggaaaccctacctctaaaaaaaaaaaaaaaagaatgagttggatatgatttagtattaagtaactgccattagttattcaatgtactgtctcctcaaacttggtatctttgttcctccagtcaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctacacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtaaggacaattccctcaaagactccccaaggatggagagtacaattgtggagggagggaggtgggtatgttctggtggggtaggaaaatgggtctaaagaggcccaaggtttctttggaaatgaactgtgggcttgaaatctgtgtcacaatgtagtgacagcagaggccctaaaatcctcagtttccttctgttctcctttccttccctcccatcctacctcaagttatttgctagctgtgcagtattttttttaatgaacttgggctttgtgaaaggtagctctatagctttcctctccctaggggatttttagaaatagtttcagctgctctgagaagaccaggtccaaataagcacagactgtccagcaccactggtctagctctctggtctacctaaggaagaagtcagttctacccttgtaagatggtggctgatcacaatgtggaacttgagccaagtcatagaatttgagactgaggggtagaaagcaaaacaacagcagtgttcaaacaatcctaggcataaccagggccattgtccaaaggacagatgctttgggaacactaagagatgacaagtgacctcaagcagaagttaatgaaacaggaaccatttgcttcacttccccaagctcagcctataacagaaatcaaccacgtttatcagtaaaggctaaatggccttgtgggccatgtggggtctctgttgtaactcctgcactctactattttaacatgaaagcagccacagttaacaaacaaaaggttggtcagatatgactcgtgaaccatagtttgccagcccttgatctagaagaatcgtcacactttagagcctaaagaatctagataaatcctatcattctcagatgggaaatctgggacccagtgagggccatgactcacccagggtcaaagaccaagtggatgtctccctacccttaacttctggtagcttcctcaatgttctttgatagatttaagaaatagatggttaagcaagtagaccccagaggctgtatctaagacctctttccccaatctttcatgtttggaggggccactctgaaggcgggatccaatgggacacagctgtcctgggatcaggaaagagaggttttctaagccatttctgcttcgccaggtgttccctcagagtcaggccatcttcctgtgttctggccctaccatgaacaaactgtggggcatggggcaagtcatttctctcttggcttcaacttagtgatctgcaataaggcgagactgaactaaaaagccccccaaatctcttctggctgtaacatcctgtgacttaatcaattcctggccatgaaacaagttaatgagtctgtccttcgttgctgaagagaaagcacctcagagttgtttgtctggtgtctccagaaggagacacattcttccttaagatttcccaagtcatctttgcaaggtggctgaggcttttcttaaagaagccattaattttatttagaagactggttcatactttgtcagaggggtgacgcttatttttgtttataagatactgaactatgcctccttttatcccatatagtctattttttttctctttaaaaaattgttaatggaagccgggcatggtggctcacgcctgtaatcccagcactttgggaggctgaggtgggtgaattgcttgagctgaggagttcaagaccagcctgggaaacatggcaaaaccccatctctacagaaaaatacaaaaattagccaggtgtggtagcatgcacctgtagtctcagctactcaggaggctgaagtgggagtatcactcaagcctgggaggcagaggttgcagccagccaagattgtgtcagtgcactccaggctgggcaacagagcaaggccctgtctcaaaaatataatgttaatgaactttatttttagagcagttttagactcacagcaagatttagagaaagatacagaggtttcccatatactcccctggcctgacacatatattatcaacatcccccaccagagcagtgtgtttattacaattgataaacctccagtgacacatcattatcacctacagaccatagtttacattagagatcactcgtggtgctgtgcattttatgaatttggacaaataaatgtataatggcatgcatccactattataggatcacaaccctaaatatcttttgcacttttcatcctcccctctaactcctggcaaccacagatnnnnnnnnnnnnnnnnnnnnctttttactgtctccacagttttgccttttccagaaagtcatatagttggaatcatacattatgtagcctttcgagattggcttcttttacatagtagcatgcatttcctccatgtcttttcatggcttgatagctcattttttagtgctgaataatattccattgtctagatgtaccagtttgtttatccattcacctactgaacggtatcttggttgcttccaagtagtggcactcatgaacaaagctgatattaacatggatgtgcaggcttttgtgtggacataaattttccacacctttgattaaataccaaggagggtgactctcagatcttctcgtaagagtatgtttatttttgtaagaaaccaccaaactttcctctcaaagtggctgtgtcattttgcattcccaccaatgaatgagagttcccattgccccatattctcaccagcattattttactttttattttttaataaaagtaaattaggcctataattatggaaaaaacagctcaaacagggcaaaatcatgtacaataaaaaataaatctccctctcatcctaaacccctaggacccagaaccccagtttccttccccagaggcaacttctgtgcccaattccttgtatctccctcctgaaattacctatgcaaatataagcaaatatttgcttgtgtataatccttcccttcttttattcacaaaagagagcatgttatacacattgtaccttacatacagcttttaaagaaatcagtggtttctacatataggtttgtaagactctcaagacagctctgaaggttatcaaacacataagctattctgacatcacagctcagaatcattccacttgacagaagtgaagaaaactcatagcccagatcaccactggaccactgagctaactctcctcctcagatctcatcagttccccagagaaagaaagatgctacaccctgcctggcctgggagtctcagcccacagtgtagaacccattgcagtgttattttcaccatttattcagatgatccacttagaaagccagaggctggaatgtcttctcatggcctcttagaattttcactgagttaatccacatttctctcctttactatcccattcctgtttttatggctatgtctcctaggtatgcctaacagaatgtgacatctagtttcttttggagcttcttggctgtttcttcctatatgacaattattcatacctttctaaaaataagatgttttatctagaatgttttggggagccccacctagtgttagaggaccgtacttcaaggttctggagggactttgagatctgaagattcctgactccttggagtcagaagactgcaatctctctttctttgggcaagcccttgtacactaatctctgatctttactattgacaagtattatacttggctctagaatttcagaaacaaactctctagagacctaagcaagcaaatatttgtttttaactcttccaaaagtgtgctgtggagtaacacaagcaaggaatggaaagggcccaggggggaggcatgaagatggaaaaatacgtttccagttgttatttattgtcatttctctggatttctaatctctttctactccatctaaggtcccagcaatccttgccaagatgatccctgtgcagataattcgttatgtgttaagctgcataatacaagtttttgcctgtgtttagaagggtattactacaactcttctacatgtaagaaaggtgagttacaagggatgagccatggctgagctctgtatctcacaccaaaagtggaatcgaaaactcaaaatgatggcaaaaggagattccaaaatatgagagataaagaaaatgcagaggcaacaaaggccagcaaagtagagaaaagtgctgttacctagggacactgaggcagaacaaggtgatctatcaaagaccacacagtccagcaaccctgggagcctgatcttcagttctgtgtcacaagatttgtttgctccataacatcagatccccctcttagagacataagagcccttcagctctaaaaatggatttcaggagtacatttatacacttgtggcataatgatgttttgattagatcaccagggtgcaatgaaggtctgagggctgactgtctgagttctgttttttttttttttttctgttttatgaatgagaaatatcttcattttccagagcagccaattctataagaaatgaatgcattgcattgcccactggggttagggatataccaaaaggcccccaaatgctcatatttttagcactaataatctcactcctggggatttactctaagtaagtgaccccaaatacagaagaacagtttgtgtgtgaagatgttcattgcaactttttcttttccttttaaataattaaaagcactaagtccaataacaaaaaatgattacatcaaggaaggggacatgtacttcacagaatattatgcaacctttaaaaatgatggttatgagaccaggcataggagctcacacctgtaatcccagcactttgggaggccaaggcaggaggatcacttgagcccaggagttcaagcctgcagtgacccagttgtgccactgcactccagcctgggtgatagagcaagaccctatctgtctctctctctcaaaaaaaaaaaaaaaaaaaaagactaggcaacgatttggaaaatacctattatataataagaagaaaaaaaatatggcataaacttggaattacaacaatgtaaactgtaaatggaaagaaatataccaaaattaaaatggttgtgctaggttgggcaggatgatgggtaacttttaaaatatttccagatttcctgtagtgtcgttatataatgttgggaattctaaaaaataatctatgttttaaaacaaaatggaaatgaccctcttttcatcaaatagtacagaaagattctgcttaactttcaggaaaggtattccctgggaagatttcagtgacagtatcagaaacatttgacccagaagagaaacattccatggcctatcaagacttgcatagtgaaattactagcttggtaagtattttccaactttcctttctgtaaagcattctttgttctaacactgagttgcagagtgtagagctggtcttcaggtggttcacgctcgtaccatcgtaccagttgttcaaacagtgaaatgtacctttactggtcggtaaacagcagctgtcctgagcgcctccaccggtgccaccacttcttcattgcccaggcctctcccctgggacccttggaccaccccatggtcttgcacctggaggcgtggcacctggcctggcatggcagagggcctgcagaagctggctccagccataccatacccattgttttataagctattaacacagttttaaatggacagataaatatcatgaagttttaaaataaattatttccacagaatgaaagagaaaaaatttaaagatgttgtttttcttttttatattcaaatttgcataaattttcatactagtctggcttttaaaaaaatgtctagaagaagaattacatctgaatatctgttacttatttttcccattttcaaaaatgttggcatgaacaatagtttcccatcatttagattattgtgagcaagtgcacacatgtgagcaagcatgaaaggaaagggtctttccattctgcagccacagatgttagctctggaaggactctcagagcatgtccagccaatacagctcaaagttcagttttaaaggaaaaaatattagccttaaatatgtcttagaagttgaggtggaggctgggcatggtggctcatgtccgtaatcctagcactttgggaggatgaggcgggcagattacttgaggtcaggagtttgaaaccagcctagccaacatggtgacaccccatctctactaaaaatacaaaaatttagccaggcgtggtggcaggcgcctgtaatcccagctactcaggaggctgaggcaggagaatctcttgaacccaggaggtggaggttgcagtgacccaagatcatgccactgcactccagcctgggcaacagagtgagactctgcctggagaaaaaaaaaaaggaagtagagatggagagacatttttttaaagctgaagtcttattccatgacaatgtctctcaatttgaaattatatcactattagaactggtaacatgtaaaaaatgtatcgtggaaatgattttacagatggtgcaaagagagctagtgcttccgactgcacagccagccagtacgtgacaacgctaggataggatctgtggctgctgtctcacagagtttgctctgtccctttgccatgtcatctctgccctgtgggccagctggcagtgacttgccctctcatcttggatctgctttcaaatgtgccagcacggatgttttcagtacattgaagacagcaacatcaatgtggtcctacttccagggaacccctgaagaacttcatgtggctttactgagcaatggtcacttagcactactttccccaaacttgactttgagtgtgagtgtcacaaaagccccctccagttacaggccttatgccccggtcttcagagatcagattagatacttgatctcagtcagggtttgatgttcctgggggaaccagtgaggggatgaagcattcttatagtttctgggagatttgtaatccagaagggatgcaccagaactcccttgcaaccattagagtagagttaggaaaatagagacaacttactttcttcaaggtcctcttagcagcctttgtgggggcagtcccagctcagaccctaagaagtctcccagggtccattttctacccagttggatcctgttaaaagctagatagagcattatttttttctgcctcatttgatttgtagaaaatgtgaaaaaaaaattttttttacttgttattaaatctgttttcctccacagtttaaagatgtatttggcacatctgtttatggacagactgtaattcttactgtaaggtaagtttgttatggacaattttggaggcagatgtgtgtctgtctaacttccgagcttctcttgaggtctgcatgtaacattaaggccctctgtggcaagtcacaagttaagaggagagggtcagtctcagtctgagcactgcaaaggggactgtgtgccttggccctgcctctgatgtcaccccaactctgggcagggcatggcctggggaaggcaaaattctgtctgtgattggctatgcaacaacttgtgcacatggtccaggacatcatctggatctctttgtttgtcttgatcccatggctgcaaaccatatctagtcaatctctggaatgtgcattccagtgggccggggggagactgaatggcccgtgatcatctcttccctcatatggcaagtgtgagggggacaagaacacccaaatcacactcctggctagagaagggtcagtggtgagctttctgcagtgagaacaagcacttattgagcacttcaatatgtaatggcaagtgctgggtgctatttagggaaacaaagaggcagaagattctcaagaaattagcaattgcatctcagcctcctctggagcacattaatacacacgtacttaggctgaggaaagaatgctctaagacagatgaagttaggtaggaaaagcagccctcgtgtagcaatgcaccatttacatcttaagtcttactattgtatttatccttataagccatatcaaatcctttgtgaaggccagacatggtggctcacatctgtaatcctagcactttgggagactgaaatgggaggatcacttgaggccaggagttcaagaccagcctgagcaacatagtgacattacatctctacaaaaaaaaaaaaaaccattttttttttttttttgagatggaatctcactcctgtcatgcaggctggagtgcattggtgtgatatcagctcactgcaacctccacctcccaggttcaagcgattctccttcctcagcctcccaagtagctgggattatgggtgtgcaccaccacgcccagcctaatttttgtatttttagtagagacggggtttcaccatgttggccaggctggtctcgaactcctgacctcgtgatccacccgcctcggcctcccaaagtgctgggattacaggtgtgagccaccactcccagcctaaataaaaacttttaaaaatctttggtggaataagagagagagagagagtatgtgtataaaatttcagagaggtattttaaaagtgatggatttctagcttggtcttgaatgaagggcaagtctggttggcagtgaagaggcacagttttcatggtgggaggctggcagcaaacagacaggctgggcccaaacacagtggctctgaagctggaggtgtacagcggacagctgctggagggctgtgaattgtttctgggaattaggtttggtttagtggacaatagccagttcatgtgtaggggatgactggatacaaacaggaatggtgaaattggaatggagttagctaagcctgtacttgaatcctggccttggcactttgtccctgagtgaccaggcaggtgttctaacctctcggaacctttgtcactgcctctgtataattgggataatctgatcaacttccctggagccttgtgaggagtaactgagataaaatttggaagattccctgtatgcagtgcctggcacatagttgatttcaacatcatctgtttcctttctagaatatgggaccctgcagtgtgatggacagctggtcccacaaggtcatttgggggatccccaaaactgtggcactcctttgattcttaaggagttactaaaagggagccaagggtgtttggaggcaaaccttcacctgtgagctcagaggcatggagggaactacttcccccacctcaggggccagtgcagggcaaatgcacctggggctcacctagaaaggcatttcttaggctccagcccaaaattatctctccactctgactccccaagctctttcagccccaaattgtctctcccctctgactccccaagctctttcctactatagcaatgttggaattggaaggatcctcagaatttctctctttaaaacctctctttggacagaggaagaaactcgggcctggagaagctgactggtctcgggccacaagggtccggacctcttgtcttaactccaagcctagtgccctcgtcatttatactcaagtgtgcagtggctccaatgttccctttaaccgtttcacaggtgtaacgtcttgcctctcctgaattagtgtataaactggtagattcttttaatgaataaattatggatggcatttgctttcctagtcccagtgcaaagctatgccatatatttcaaccaatatagaataatttttatcaagtacacctttctcactgccctattacattccactgccactccctgccgcctcccccgcccccgcccccgccccaccaaatcccatcataaatgaattatggtagaaaatattaaattacaatgctgaagcccattacattttttgggctcccttttgagatgattgtgcctaaaaatggaatttgattcatgttttggatttttcttgattgttctgaggacccaaggtggctgcaaacattgcttaaataggttggctatattttcaggcttctgcatttattcgagagtcaaaatgaaattttagctgggcacggtggcgcgtgcctgtggtcccagctacttgggagactgaggcggcaggataagttgagcccaggaggtctaggctgcagtaagacgtgatctcaccaccgcactccagcctggtgacagagcaagaccctgtctcaaaaaaaaaaaaaatgtcaaaaaggtgtatagaaaaaaacatttagacaacaaaaatatatcctgaggcttaaaagcacagagcgacaaatcagatagtgaatgtttttaaaagtcatttttccccctgtttcagtgattgtatcacttgattcattttggacaatgaaataattaaacttggcacagctgtgcttagggctccgaactgcagtgctgattagagagagagagagagagacagtgacaatgtcttgctcatggcaggcacttcatattgctggtaggatttgctcatgtttcccgcagccccggccctctttgtttcagttctcctctgggtcgtgtgtgtccaggcccaatcatgttcccactctgaaactgcctgctgacttcctggtcctttctgggagtgatccaggctctctatggctggttactgctttctccatgcagagggagggacacgcgcccctctgtctctcccaaagaaccagactgagatttaacagctgctgtcctacagaaagtgacaatttcccatttcaggtattacttgttctaattctggttagctctaggctcctagatccttaaaatgtgattcataatttttccaaaaatggttatccacaattttcctaagttttctccaacagaacattgttttcaccataggtttcctctgaatacacatcaaatggagacctccaagcctgtacattgccatctttttgcagcccccggcctccatatgtgggtccgaatcatagggacaggacagcgggtcaggactagggccgggagattcgggagtctgggagattagaattatttgttgattcttcagttcaattcattaagtgacagattcatctcatttttagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgattgtaagtattgtataattttattcaaagttcacctgaagacctacctaccttttttgtaaaccttttcattatatgtgaaaaggagacaagaactgcatcattgaactgacaactgtctctaaatttctttttatccaattcttcttcccttttcttgttcgcttgccctctgcttctttccaaccatgtcccaagtcatcaaactgaccagtgtgttcctctctacgaaggtataaatgaccagacaaaccactgctgggcagggaaagaaaaaggagaaacaacagggctttatgtcaggttaaagatttccaaatgattacagaaaattttacctgtggctgggtgtggtggctcatgcctgtaatcccaacactttggaaggctgagatgggcggattccttgagcccaggagtttgagaccagcctgggcaacatggcaaaatcccatctctacaaaaaattagccaggtgtggtggtgcaggtctgtggtctcagctacttgggaggctgaggtgggaggattgcataagcccaggaggttgaggctgcagtgagctgagatcacgacaccacactccagcctgagcaatagagcaagaccaagcattacccgtactattttcccctttagacacacacgaacccaccatgtagctgtagcaatttgcgtttgctgtgttacgaaggtagtggccaaaaacaaccatcatttatttactgcaaccctagaattctatgggtctgaatttgagctgggctcaagtggatagtgtgctgatctgggccaggcttaattgatctctgctgggctcacttaagcatctgccattagctgctgggtataaatggtttgtctctgctccacatggtctcttatcagcagacccatccaaaggatttcaagagcagcaagagggtaagattcaatgcacaaatatttctcaagtctctgcttacatcacagttacaactgtccaattggctaaagcaattcgcattaccaagcacagtgtggaagggccctgcccaaggggtacagaaaggtgtgagtaaattgatgtcatgactgcagtcaacccaccataacagtcatcagaagttcctcaccccagaggtgacccactggggccagtcccgggaagaggtgtttgcagctggttctcagtcctggttgccaaatccagaatcctctgttgagccacaacttatttgacttttctatagcatttgacactagtatccttcccttctagatgttcccttcttcctgggcccgcatccaccattctcctaatcgccttcgtgcctccctcatccttctttttgctccttctaagactcctttcttcatctcttaagtgtttgcttttttgtttgttcatttgtttgtcagggtctcacactgttgcccaggctggagtgcagtgggatgatcttggctcaccacaacctccaactcccgggttcaagcgattctcctgcctcagcctctcgagtagctgggattataggcatgtgccaccacgcccagctaatttttgtatttttagtagagacggttttcgccattttggctgggctggtctcgaactcctgacctcaggtgatctgcccgccttggcctcccaaggtgctgggattacaggtgtgagccaccatacctggccggaaaacactttcctgttctccggcttcagtggcaaagataaattgttttctttgcccaaaattgtagaatctcttgctctaggcttttaatcagaggcattttcatgtggcaggtgatgaaggaggctcagttacagtttgggatgtttagtagagaggagccatatgactctacctactcctattctctcccccactccattctcagactcatcatttttttttttcttcccgagacggattcttgctctgtcacccagagctggagtgcaatggcacgatctcggctcactgcaacctccgcctcctaggttcaagcaattcccctgcctcagcctcctgagtagctgatattacaggcacatgccaccacacccagcgaatttttgtgtttttagcagagatggggtttcaccatgttggtcaggctggtctcaaacttctgacctcgtgatccaccagcctcggcctcccaaagtgctgagattacagacgtgagccaccacacccagcccagactcatcttttaaccctaatgccttccaacccatttttatttctttatttatttttatttatattttgagacaaggtctcactctcgctcaagttggagtgcagtggcatgatcatggctcactgtaaccttgaacttctgggctcaagtgatcctcccactccagtctcctgagtagctgggactacaggagcttgccaccatgcccagctaacttttaaatattttcactgtgttgtccaggctggtcttgaactcctaggctcaaacgatactcctgccttggccttctaaagtgctgggattacagttgtgagccactgcacttggccccaaaacttattaaaaggcaaagtataacagcaatggggtggggtaattttcacaaattaccttatccatattgtcatgctgaatatatttttaaactatttgtgcttctcagtgacccttcggtgtgattattatggctgtaaccagactgcggatgactgcctcaatggtttagcatgcgattgcaaatctgacctgcaaaggcctaacccacagagccctttctgcgttggtaagtgtttcacctgcttctaaatgttcttcataacatcactttctcttcttttgcaacataaaaaattcactcctttagtttccacatgcatttcagagtccgagtgatctgacttctgactttagacatatggaccatggctgggacctttgctagcccatgtccagcttcacagggggcacatcatgtgtggagtcaataagcatctcattttacctagaaaaagcaatgtgaaagacactgtcatgttgtcacatgtgactttggggttaaagagattgtttctgaaaattacccagaaatcattctgttttgaagcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtaagaaaaataactttgtttttgtcttgccacagctggagctaggcaaagtagagagaccttacaacacgtatataggtgttgagtcaggaagctggtaagctgtcataggttggtagagacagcatcctcatcattgtcatcatcaatagtttttttttttttttttttttttgagatggagtctcactctgtcccccaggctacagtgcaatggtgcaatctcagctcactgcaacctccaccccccaggttcaagtgattctcctgcctcagcctcccgagtagctgggattacaggtgcctgccaccctgtccagctaatttttgtatttttagtggagacggggtttcatcatcttggccaggctggtcttgaactcctgacctcatgatccacctgcttcggcctcccaaagtgctgggattacaggcgtgagccaccatgcccagcatcatcaatagtttttgagcattctctatgctccaggaaacacactaggtaatacctatcacacagcaacattgtcaggaatgtcttaatttccattttcaggtgaggaaactgaaactgattgtaaataacatcctccagctcacagggcaacaaataagtggcagagccatgtggcgtcacagcctgagatggtcccactaccctccatgcctcttgggttcagctttgcctgaactgcagaatcttcctgaagcccggaggatggagtgttcagtcagtagcaaatgagcctgcatgagattgcgtacccccctcacccttccagaaccccatggaaggtggtctcctggaagaatgagagtgtaaggaaggcaaaagaaagaggaaaaaaagcaagggaggacagaataaaaggaagatggaaaggaagaggtggagattggggtgggaactctgacatgctccccacaggggctctttaacactgtttcctattgctcactgtatttcaggtgtgcatttggctacagtggactcgactgtaaggacagtgagtatgaaagtcttgctattataaacaagttattaaacatctgagaaatcaatagtgaccccattcaacatcctgcccagtccttcaaagtctctgtcctctttcataaagagagagaccatctgcctccagtttgccttctgggtcctgccatgccatgcccacccttaggttatgaacagcagcccctctgccatagaaaataacagaactcagcaccaggagtgggctggcacctctggacttgcttgagaccagagaagggcatcttagcattatgttgatttcctgcattagcttacatatgcattatctgctgctactagagataaaagaccagtaattccaaaaattctggtggttatagaagagcagacctagaaaccagacatttaaatactcaaatccttttgtctcagagctatttactggtttgggatattttgctgcaaattcaaattctgtaccctcccatgccccacccccaccagattaagacaatactaactttaaattttcaattattttatattctaaaatttacataatgaactaaagatcagtcttccaagatgaaggaaatattactgtcagccttcctgccagccatgaagatagtgatgagtgacattctccatttctactgtattttattgcaaggaataatttgctaagtctttcttcagggctttcaatttccacatctataaaatgagaagtttggaccagacaaactttgaggtctttcccagatttgccagtctatggccccatgaattcacattaaaggcagcatttggggaagccatatagcagaaagagacgaagaggtctagagcagtgttgtgcaatagaaatattatgtgagctacacatttcatttgaaattttagaaatttcaagtaaattgttagaagtaaaaagaaacagatgaggttgattttaagaacatattttatttaatccatatatccaaaatatcatttcaacatggaatcaataaaaaaagataaaccaattctctcacatttttttcacatgaagtgtttgcaatctggtgtgtctgttacattgtgtctcatagccgcagtcaagtgtcaatagtgccaaccagggcagagttaggagaggagaatgggtgataatgaacgtctagactcttccctcattgatgttattatcaagccattagctggctcctctagcagtgacatttaactccaacctagtttccttagcttatcagtaaggtgaggtatggagggcaggcaaaggcagcagaggtaaggaggcaggtgtggccctcagctgatactccactccccacaaagtccaggaagaccctgccaccatcctttgtatttacagtgttttgtctggcagggctgccctttccaattgagttctgaagacacagtttaggaggtgtgaggagggaatgctaaaggaaataggccaactacccaacctggcctggagggttggagaccagaacctgatcgtcttcacagctaggagtccctgggaatacacgaacctgtgcagtagacagttgggggccagcttgttggagactgttcttattttcttcttcctttcagaatttcagctgatcctcactattgtgggcaccatcgctggcattgtcattctcagcatgataattgcattgattgtcacagcaaggtatgggatgaaagtgtcctttttaaatttttttttttatagagagatgggggggtctcactatgttgcccatgttggtctcgaactcctgaactcaagccatcctcccaccttggcctcccaaagtgctgggattacaggcatgagccatcacacctgccagaagtggccttttcctgcggcacaggaccaccagcatgacactctctagtttccaaacatactcatcctctcctgggcaagagaagggagataaggagaggcctttctagtaccactgactttttttccttaccttaattgtcttcttattatataggcaatagcaggaccatggaagaaaatcaagaaaatagagaagtgggtaaaggggcggaatttaaaaatcactcacaaaacccaccatgctgaggcaactaacattttgagatataaccttccagatttatttctatcttttaaaataatattatatacataattttgtgtcttttgtgtttttaaaattttggattgaggttttttttggtttaacaccgtaagatgacatagcaaccatttccttatgtcattaaaaactctttgttaatgtaataatatttaactccactgaagttgtcaaatacaattttcatcaggtcacttccctgtccaggactctgctgcaaatggtctaaaatcaacctcaactgaaccccctgggttgttgtttttttttaactttttttaagaaagtttatcacgttagccgggcatggtggtggcacccctgtaatcctgctactcaggagggctgaggcaggagaattccttgaactgggaggcagaggttgcagtgagccaagattaccccactgcactccagcctgggtgacagagcaagaccctgtctcacatacacacacacacacacacacacacacgcaagcacacacgtnnnnnnnnnnnnnnnnnnnncacacgtgtcatctctgcatggctattagcttggtgccttaggtctcttctcttaaggaaggggcactagagttcattcattcaacaaatatttagatagactaaagtccccccattaacagggaggcaaatgctgtgatctttttcccattctcaatgtgccaagtggggatccactttgattttttaaagctactgttttctaacatttagttcatatcttatattttggcaaaataggtagttttccactataatgtgacaggataaacagattttaggttcctacaatattttgttcttgttttttctctttttttttttgagacagagtcttggtctgtcgcccaggctggagtgcagtggcatgatcttggctcgctgcaacctccacctcccaggttcaagcgattctcccgcctcggcctcccgagtagctgggactagaggcacatgccactgtgcctggttaatttttgtatttttagtggagacgaggtttcaccatgttagccaggctggtctcgaactcctggcctcaagtgatctgcccaccacggcctcccagagtgctgggattacagaggtgagccaccaagcccagcctcgtttcaagtctttgaacttgttttactcattttacccaccaacgtgattcttagatgttgactttgctgaatgaaatgctgtatctcaaattattttctaatattatgagcaaaatatgaatgaggccagtggaattagattgttatgttggatcagcattgaagtccaggttttgtcgctacacagagctcatgaccttaaacttaggaaacctacactgaataaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattaggtgagtcagtgggctttttctcctgcttttgggagtgaatgcaccagggcagagcagagacctggttgctgaatcttcaatccttggctgccccgcaggctttctttttctttttcttaattgaaagagagagagagagagagatcaaaaaggaagttccctgctgtcgtaactctgagcatctatgtgactacagacacatcacttaatttccctggcctttgattttctcatctgtaaaaaggtcagcttaatttagatacccctaaggtccctttagattaccaactccatgaatacgactccagagattatgatgatgacacttctcaggctgtttgaagacctaggtcctcagccaggaccagggaaggacactggatgtaaacatagttctgtgggatccttttcaccaggctgtgtaaaggcaacgctctctttccctgccgcttgatctcaaggcaactctctctctctctctctctatatatatatatataagttctatttgttgttgttgttgttttgagacagggtctcactctgtcacccagacttgagtccagtggtacgatcttggctcactgtagcctcaacctcctgggcttaagtgatcctcctacctcagcctcccaagtagctgggactacaggcacatgccgctatgcctggctaattttggtattttttgtagagacaggggtttctgccatgttgcccaggctggtctcaaattcctaagctcaagtgatcctctcgcctcgtccttccaaagtgctgggattacaggcatgagccactgaactgggcatcagtccacttctaaagagatgaaatggaacttagcttgttggctcatcccatactcctagcactttgggagcctgaagcaggagaattgcttgagcccaagagttcgagaccagcctgggcaaataatgagaccccatttttacaaaaaataataataataaaagatagctttttaaaaaaggagataaagctagttaggctggtgatactgtatttctctagggagaactttcaaggacaacagcttgtacccactgggtttgtattggataatcatagctgtcactgcttagtgtgattgaatgaaatgttgaaagaaggaagcctgtaagagactttaggaggaagagtgacaggagacagatggaaagaaggaagatggtaaaggaagaggagaaagggagctgggaaagagatggggaatggaagagacgtgagagaaatgatagggagaatatgggataaagctgaagaagacaaataatgttaatgaaagtaatgttaataatttacagatctaaacgatctcatatgtttctgttggagtattttctaagagtattgtctctccctctctctttctgtctagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccacctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgtccttgtgtctggggcttttttttcatttctttttctttctttctttttttttttttttttttgagacactgtcttgctctgtcacccaggctggagtgcaatagtgtgaacatgactcactgtagcctcaaactcctgggttcaaacaatcctcccatataagcctcctgagtaggtggggctacagaagtgtgctgtcatgcccagctaatttttttttttgttgttagagacagggtctcactatgttgcccaggctgagtttgggggttttgatgatgcacacagcagttagtctcattttaaatagcaaacgtgacacatggtaaatgggagtgactgatatctgctatccttattaggggttattggattacccaaggataacgttctactgcatagtagacatttgcttcctccacgcacatcccactcctaccccatgatgatgagcattttgggtggggctgatcctgctcccagctacagaggttggctctggttggctcaagccaatcagcgaaatcccatgcctccttgccacagtaatcgtcctaaaagtgaacgtgtggcataagtggatacaattagaataaagcctaaactttggtaggaagtttggagaaagagaaactttcttcttctggaaagtgggcttgagggtgtgaagtcttgaactgcttctgttttgctggggacaaagctgacacacacagaggagaagaactgagagaaccagagagaaatggacctggcaccttgatcaaaccatacctgaagcctctggaatttcctctgctacaaggccagtttgagtagttttttcctgttatttgcagtcaaaaaatcctcactgataccacttatgtttattcttgtattctcatggctaaatggtgaatcacatataagaaacatactcttatgagctattaatgcccacactgaagacattagccataaaccaatcagttaacagcagcagagttattgcaggcagaacttaaaattggctggccactgtattttgtcatcacagactctatttctgacctgcatattaccccctttgtatttaaatatgattctggattcagtactagtagaaggctatttctaaagaggcctttcccccttcctgatccccctttggaccagagcatgccaactcctgtcacttctcaaaggtcctgagccatactaattctgggcttcctgggccattcttcaaagacttgcattgctattgtttgactaaaaataatctcctaaagatatatatgtataatgtttatgaaaatggcttttgcatttggattcaaaaagttctttttgattattgtgcaatatgacctataattcatttgtttctgcttgctggtaactttgcaaaggttctcttactaattgttctgccactttggagggctgtcagagtgaactttctacgatgcatatctgattgtgacactcccttgcttaagctttcaggggtcatccactgagaaatagagctcatagaataaagtcagactcctggtggcatggcactcctagacatccagttactgccgctgattgtgctggctttgcctcatgaccctccccacgatgcactaccactttggccatacctgctgtttcctaaacataccacctctttaatttattattattattattattttattttatttttttgagacaaggtctggctctgttgcccagcctggagtgcagtggtgtgatcttggctcattgcaaactgcctcccaggcttaaaccatcctcccacctcagcctcctgagtagctgggactacaggcacttgccaccacacctggctaatttctgtgtttttgtagagacgaggttttgccatgtcaccaggctggtctcgaattcatgagctcaagcaatccacctgccttggcctcccaaagtgctgagattacagacatgagccatcgtgcccagccaacatatcatctcttcatgcctccattcctttgctcatgctttccctcttgcttttcctcatgctcatgctttcccattttggaatgcccgtttccttcaactacctaatgtcttaatctgtttgagctgtattacaaactaccacagactgagtggcttacaaacaacataagttatttctcacagttctggaggctgggaagtccaagatcaaggtgtcagccaatttggtgtctggtgaggacccagttcctcatagatggccatcttttcactgtaacctcgcatgttggaaggagcaagagatctctctgggtttttttttttgtttgttttgtttttttgatggagtcttgctctgtcacccaggctggaatacagtggtgcgatcttggcttactgcaacctctgcctcttgggttcaagcaattctcctgcctcagcctcccaagtagctgggactactactgcagccatcacgcccggctaattttttgtatatttagtagagacgaggtttcaccatgttagccaggatggtctctatctcctgaccttgtgatccacccgcctcagcctcccaaagtgctgggattacaggtgtgagccactgcgcctggcctggggtctcttttataaggacattaatcccatccatgagggctccaccctcattaactaataacttcccaaaggtcccacctcctaatagcatcatatcaggctttaggatttaatacatgaatcttgagggtacctaaacatttagaccacagcacctgataaatacctccatctgtctagatcaactaaaccattttctcctctggctaccccagtactctcaagtagagttgcctccttcatgtcccaactggtcctgtaaccagttcccccagagaagtggttgtatccatggttccttctaacccagcacaatgcctggcatagaacaagtattaaataattgtgaaatgggagtgtaaaacaggactcttgcagctcaaccttgaagaatatgatcattatcttgattgtggcactggtttcacaagtatacacatgtcaaacattgtccaattgtacactttataaatgtacactttggtgtatgtgaattataccttcacaaagctgggtttttttatttttattttttaagtggggagtgaactattatgcagagctgtctccaaccttgagggcggcaccttctaggcacagccctaagacaggacgagaaaacgcacatgtcacactgctggcttgtcgcattagaccgaaggtcctctgaggttggctttgggtgaaacaacaggaatggcccgctgccctgacagcggcaggtcttagcttcacattgggatcccctgaggaggtataaaagttactgatgcctgggtcccattccagagcacatcagtctagggcagacctgagtctcaggagtatttaaactctcacctgcacgtttttttgttttgttttgttttgtttttgtttttgacagagtctccctctgtcacccaggctggagtgcagtggcacgatcatggctcatggcaggctctaactccggcctcaagccattttccccgctcagcctcctgagtagctgggattccaggagccacccgccacgccctgcgctcccaggtgcttctaatgtgcggtggagtttgagaaccactgtttcaggtcactgcgttggctaatggtccaactcgaggtcacatcacatcatttcccattccttcctccaagagtctagaagccaagagtcacattgtggacaagaagccccagtaagctccaagtctctctatggagaaggtgaccaggcatccagattgcatcaacaccaaaaccgtttgaggctgaactcttttgtgccattttgcccccaaacctaccctggccttccgcccctttctgcggctgggcaaatctcggggccggtaggtggcgctgtctcctatggcttgcagaaaactcaacttccggcggggcggagcttttaaaaggcttttttgaaatcattaactttcattttattatttctttttatcgagacagagtctcaccctgtcgcccaggctggagtgcagtggcgagatctcgactcactacaacctctgcctcctgggatcaagcgattctcctgcctcagcctcccgaatagctgggattacaggtgagcaccaccatgcccgactaattttgtatttttagtagagacagggtttcaccatgttggccaagctggtcttgaacccctgacctcaagtcatcctaccgctttggcctcgcaaagtgctgggattacaggtgtgagccaccgcacctgaccttaaaaccattaacttttaatgcaccatttctaaatttctccttggacttttccttggttggtctctttattccttgttcttgtgctagggagaaatgaatgttacgctgtttgctcttgttgagatatttgcatcatttttactgaatcattagagatcatatattgtcctctttattgctcttataatacataaccataagcaatgttaatgtcatattaatggtgcataaagtttggtacaattgttcagagaaatcaatgttttatttagcggtgattgtacaaaattaaaaaggagataaatccattttcattgaaaaattcttcagttaaataaaaaacaaaatgccacccgtgggaggtgaggtgagcaagatctgtctgggttttccctgagggttctccgagaactccagtttgccattaattgacaatccacagtgcaaaaagcaaggttggagattaggttggggagagccctggaaaacatatgggggtgttcttctcagtctcagggctatgaaatgtggtgcttttattcaaagacagaagcctggggcaaaccatcaaaggcctcataatttctgcaggcctggtaacatttttcctgagcccacaatcacgacatgtgggccaataaggaaattctctgctacttccaggtgagagagccagtttgaaaatcaacaacaacaataatatttcatatattatgaagcactccctatatgccaggcacaattcttgtgcctcacacatattaacccctttaattctcacgataattatgaagtaggtactgttttcatgcctgttcaatagtaggggaaatagaggcaagtaactagtctgcagtcacatatctaggaagtgacacagccaggatttgagccaggcagtccgactccattgcctacctctctgtcatttaatgttaaagtattaacagaggtaatatatttcaatagtcagtaggaacaatgtgacatatatttgaagctgagagtgtcctgtatttaccaggacctggtgccagatgcaaatagagtggtggatgaaacacaggcttcatcgtcctggagctcacaggttaatggcctttattaccaaaagtgcaaaactctttctttacttatgtcattgttcaaatttcataaagtattctcatattctctccagtaaagtaactcatctaaaactacctgcaacatgcctgctgctgcttttttttttttttttttttttttttttttgagacagggtcttgctatgctggcgaggctggagtgcagtggcatgatcatggctcactgcagccctgacctcctgggctcaagcaaccctcccacttcagcctcctgagtggtgggaccacaggtgaatgccaccacacccagctaatttttaaaatattttggagcgatgaagtctcactatgctgcccaggctggctatgatccctgggctcaagtgatcctcccaccttggcctcccaaagtgcttggattccaggtgtgagccaccatgcctggcctgcttctcatttattaccccagatatgacttcctctttgtttgggaaccctccagcttttctatcttgtgtgaaggctctccattctctaatcagctgtggtgtcctgcccttatgcagtgatgggaggaatcttggaggcttctttccttttggtggaaacaatagcctcctgactgggtccaagtcaaaaatgaatccccactggacagccagcccctttgctgcacctgaacttcctgagggaaaatcctctgttttatttctttgctatgtaaaaagccctcaacaaaatttattgaatgtaaaaattaagtccctatttcaatgaagtggcatggcatcctagagcaaagcgtgtcctggaatatgaaaacaaataaatagaatcagggctaagatttgaaagcatctcttagccagccctgagtaaggggtctttaccattttctttctttcttttttcttcttttcttttttttcttttcttttttttttgagacagagtctcactcttatcacccaggctggaatgcaatggcgcaatctaggctcactgcaacctccgcctccctggttcaagtgattctcctgcctcagcctcccaagtagctgggattacaggcatttgccacttctctggctaatttttgtatttttagtagagacagggtttcaccacgttagtcaggctggtcttgaactcctgacctcaggtgatccgcctgcctcggcctcccaaagtactgggattacaggtgtgagccagtgcgcccggcctttttttttttttttttttttaagacatggggttttgcggttttgctgtgttgaccaggctggtctcaaactcctggcttcaagtgatcctcctgcttcaacctcccaaagtgctgtcattttccttttttttttttttttttttttttttgagacggagtctcgctgtgtcgcctaggctggagtgcagttgcacaataaaggctcactgcaaactctgcctcccgggttcacgccattctcctgcctcagcctcccgagtagctgggactacaggtgcctgccaccacgcctggctattttttttgtatttttggtagagatggggtttcactgtgttagccaggatggtctcgatctcctgacgtcgtgatccgcctgcctcggcctcccaaagtgctgggattacaggcgtgagccaccgcgcccggctgtcattttcttaatgaagagaattaacttacacgatatcctctaaatggtacataagtctcattccataatagagtatctgtcatttttaactaatcattttttgctgctgttatccacagtctcaagttaaaaaaaaaaaaaagacctcaaagcatcaatacaaatagatatttggacaatggacctcacctgaatattctaatcaagccacatctattattgctcatgtgtcttcctgataagccccctacccctacccccataaagtggtgattcaggtccttcctgttttgttttcaaggtcattactgctctgcatcaatccagtagaaagccaaagaatatagaggattttgcaagagagatttttttatgaatcaagtctggtattactgcacctcatttccccccacatcatattggcttagaacttgtcacataacagcacccaacaccccaagggaggcagggggaatatagaagagctacttgtctaggaagatagcactttgtgaacagctctctagtctgtttctctcccttccttcaccttacaaaatttccttatcctttgagacccagcataaacaccattatttatccctaaccctggaacagtatttgtcacatggtatacactcaataaatacttgttggataaatgcatcattccacaaacatttaaaaaaaaatttttctttattttgtagagatggggtcttgctatgttgcctaggctggtcttgaatccctgagctcaagccctcctgcctcggcctcccaagtgctgggattacaggcatgagccactacgcctagccaacagacacttttttcagtgcccactctcagggagttgagtaataagtcagagattaattacataagcaaataacttcaacctcaactcttccaatggaggcaaggaccaagttctctaagaacatgaaggaagccagctgtggtggctcacacctgtcatcccagtactttgggagggcaagcagggaggattaatagagcccagaagctcaggcaacatactaggttgatcagactgggcaacatagtgagatcccacctctccctccaaaacaacaataacaacaaaaacaaacaaaaaagaaggacatggaggaaaacattctgtcaacagtagttctggaaggcttcacaaaggaagcaacatttgagcggggtatcaaaagacaaataggagtttaccagtcagaaaagatcagggatagggcctttggaggaagaaacacaatctgcaaagataagaatgtatctgtctgtgagggtgggagtaggggccaggctctgaagggctttgtgagttgtgcaatctgattcctggtctacttcagtatactttgatctttcaaatatacctggtatatgtgctctgcctcctttttctttttaaattttttttttttttggcttttcttttttcttttgtagagacaaggtctcaccatgtttcccaggctagtcttgaactcctgggctcaggtgatcctctcacctcagcttcccaaaatgctgggataacaggcatgagccacgtgcatgcccagcttcttcttctccctttttttttttttttttttaagacaaggtctcactctgtgtcccaggatggagtacagagtggtgcaatcatagctcactataacctcgaactcctgggcttaagcaattcttccacctcagcctctcaagtagctgggacaacatgcatgtcattactgtgcctggctaatttttcatgagacgagctttcaccatattgcccatgctggtctgtttcaagctcctgggctcaagcaatcctcctgccttggcctcccaaagtgctgggattacaggcatgaggcaccacactcagccccctacatctttttgagttgactaaagccaagtgtggtctctgaaaggctaagagtctgaatgtctagtctaacataagaagaacccctagtgagcattgcaggcatcatgttttatattatggtctctgaaatattggaggggacagtgatcaatctccactgaagctgggagaagaggaaactatcaaatgcccctgagttacaaggaatgaagtatttcctgattgatgattaaataattggggtggattcgctaggaagctgatggaggcctcttgggacagcctttaaagaggaaaggtgatcatttttagagtccacccgtaagacaggccctcatagtcttcccacataaagaacacgttcaaacaggcattccgtcttctatgcaagcacattgcttttttgtagaagaatttttagtcggcatatcaggttatgtaaagtagagcctgctgccaagtgcggaacacatttggctttgcaagtggtaattatagagccagctctggcagggaccaggcccttcactttccagatgagcaaactgaggtccagagggtggcaggcagttgcacggttgctcagctaattgatggcaatgaggactggaactcaattcttctgatcctgggcccagatttctcattttcctccaccagcaattgaatatgaggggccgtattctacaaaaggggcatcagctactgcaaacaggtgaaagctgggtcctgggctggtggctgatggctgagccatggcttcttgtgtacctggtccttgagcagctgctcagcctccattccccaccccagccccaaacatgacaccccaagaagggtaggggtccagaagcttgtcccatcttttgaaaggctgctgaactgctagctaagcactgttttaaaggccactagtatacctaagacaaggtaaaggtgagaggcatgatggttcatgcctgtaatcccagcactttgggaggccaggggcaggaggattgcttgagcccaggag

SEQ ID NO: 5 - DNA, 2837 bp, Homo sapiens
atgaaagccatcattcatcttactcttcttgctctcctttctgtaaacacagtcaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctacacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccacctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatg

SEQ ID NO: 6 - protein, 512 aa, Homo sapiens [sequence omitted]

SEQ ID NO: 7 - DNA, 108845 bp, Mus musculus
  misc_feature (1)...(108845): n = A,T,C or G
tgaggttgaccacacccattaaaaacacaggaaataaacaatctcacagcagtgaaatcaaaagaaaaggggcacatacccaccaccacagcaccaactccaccaataacaaaataacagcaaacagcaatcattgttgatcgatatctctcaatatcaatagtatcagttctccaataaaaagacaactctgtactgaatgaaaaatgggtcaagatagaaataaagaagttaatgactttatagaattcaatgaaaatgaatacaaattatacccaaatttatgggatacaatgaaggctgtgctaagaggaaaagttataacatgaaatgcttaaacaaacaaaaaaatggagaaatctcatactagcaagttaacaacacacctgaaaactttatagcaaagagaagtaatcacacccaaatggagtatatggtaagaaataatcaaatagacactgaaatcaataaaatagaaacaaagagaacaatacaaagaatcaactacataaagagtgggttctttcagaaaatcaacaagatagacaaactctcatcaacactaaattaaaggtggagacagattcttcaaatcagcaaagtcagaaacaaaaaggggaacataacaatagacagacgcaaaggaaatccagagaattacaaggatagactttaaaaacctgtagtccaccaaattagaaaatataaaacaaatagataattttcttgatagataacacttatcaaagttaaatcaagatcagataaacaatttacatagacctgtaattcctggtaaaataagaaccaatcattaagagtctcctaacaatataacaacagctcaaggacagattgttttccctcagaattctaccagactttcaaagaagagttaacaccaacactcctcaaatgattctacaaactggaaacagaaagaacattgcccaattcatttttatgagccctcagttaaacagatgcttgaaacacataaagattcaacaaaaaattacagaacaaattccgttatgaacataaatgcaaaagttttcaataaaatagttgaaaatcaaatctaaaaacacatcaaaaatatcatccaccatgatcaagtagggttcctcacatagatgcagggaggttcaataattgaaaaatcagtaatccatcatacaaacaaaccgaaagaaataaaatgacatgattatctcattatatacagaaaaggcctttgacaaaatccagcaccctttcatgataaaagtactggagagattagtgatacaagggacatacctaaacataacaaaggtaatttacagcaaaccaatagccaacatgaaattaaatggagaagagttcaaagaattccactgtattaggcataagacaaggctgtctatttcatatctactcaatatactacttaaaggtttagctaaaacagtaagaaaatggacaaaaggacaaaaaattggaaaggaacacatcaaagtattgttatttgcagatgatatgttagtatacataaatgactctttaaaaatccaccaaaaaaaaatcttacagctaataatgactttcagcaaagtgcatggattcaaaattaactcaaaaaatcagtagcactccaatatgcaaatgacaaatatactgcaagagaaatcagggaaataatgcctttcacaatagcctcaaacagtataaaatatcttagaataactgtagccaagcaagtgaaaaaaacaaaaacatctgataaaaactttgagtctttgaagaaggaaattgacgaagatatcaaaagaagaaaagatctcttatacccatggatccataggattaacatagtacagatgaccacactactaaaaactatctacagattcaatgcaatccccataataattctaacccaattctttatagagctcaaaaggacaattcacaaattcatatggaacaacaataacaacaaaaaaacaagagtagataaaacaatcctgaacaataaacaacaacaataactgctggaagtatcactatccctgatttcaagttgtactacagagctatagtaataaaggttgcatgatattggcataaatatagacatgtcaaacaagggaatgaaattgaagaccaaggcataaatttaaacacatattgacacctgacttttgacaaagaagccagaaacacacactggaaataaaaaacatcttcaacaaatggtgctggtctaactggatatctgcatgtagaagattgcaaatacatcaatatttatcaccatgaacaaaattcaagtccaatcgatcaaagatctcaacataaaaccagatacactgaacctgacagaagagaaggtgaggaatagtcttgaacacattagcacaggagtcaactttctgaacagaacacagaaaacaggggcaccaagaataaaattaattaatgggttctcataaaactgaaaagctcctgtaaggcaaaggacatcatcaatcaaagcatcagtctacagaatggaaaaatatatttaccaagtccatatctggtacaggactaatatgcaaaatatatataaaactcaagaaactaggtatcaaagaagtgggagagggtgggtaggggagcagggtggacggagggtataggggactttcaggatagcatttgaaatgtaaatgaagacaatatctaataaaaaattgaaaagaaaaaaaaaagaaactaggtatcaaaaccacaaacaattcaatgaaaaatggggtaagatctaaacagaattctcaacagaggaatctcaaatggctgagaaacacttaaagcaatgttcaatattcttagctgtcggggaaatgaaaatcaaaactattttgagattctaaagctatgttcagatttatgcctatcggatatctatgattactaacacaagtgaagctaatgctttcaaagatgtggagcaagggaaacatccctccattgcttgcatacttgtatagacactgtggaaatcatatttccattgagtgtgtatttgtatagacactgtggaaatcaatacatcggtttctcagaaaactgggaatcaatctaactcaaggttcagatataccactcttgtgtgtatactgaaaggatgcttcattctgccacaaaaaaattcttgctaaatcatatttattctctagtcataatagccatgaactgaaaatatttacacaatggagtattactcagctgttaaaaatattacatcatgaaatttacaggcaaatggatacaactaaaatttctttaggggcaatgcatggatttccctgggaaggagaaatgggacaggttttgtggtagactggaccagctggggacaggagtaagagcatagaatggaggtacagaatacagagaaagacagctagaattaggaacatatggttgctggtttggaaatctagtacagtgaaaacttcctgggacctatgagggtgatcctaatgaggactcctagtaatgggtaaaatgggagaagtaactcgccatctcttatagcaaggcaagtcttccagtggcaggtctgggttgcatttcgttgacttgttggccaagggggcccatgggaatccccaaacaatccaggctgataataaaataaaggtctcctctctacaaactggcattggggtcccactggcaaacacaacatccatacatctcattgactgtgggggagtcaagctgataactaccttcagccctactgtctagtctatttagtgtaggaatatactctgtaagtaagagaaagagagatttgtaaattaacttagccacaaaacctttgacctatgatctatcctgcctgaaaaaaatatgctagggcaatggtggcacagaacatgtgggagtggccaaccaatgtctggtttgacttaaggactactctacatgaaggaatgcatacccatcactacctgggtaaccaagaaccagagaccatatagcacagagacctaagaaaaaccccaggcactactagtcaaataaaaaagtatcagtaaaatgataatgaatcctaattatattctgttatactggtagatcagtgctttatctagtaatcatcagtgagtctccctccagcagatgggagaagattcagagacatacagccagctatgttgtggagaaagagtttaaatgggaggtcttcatcaaatccctcccctcagaactcaggaaatcctgtggaaggtggaaagattgtaaaagccagaggggatggaggacaccaggagaacatggccttctgaatcaactgatcaaggtgcatgtgagttcagagactgaagccacaagtacagggcctatacaagtctgcaccaggtcctctgcatatatattatagcgattggcttagtgtttttatgggacttcttactgtgagaaaaagtgggtcactgactcttctgcctgctcttgagactcctttcctcttttgggtgtccatgtccaacatcaatataatagtttttacttcatcttattataatttattttgtcatgtttggttgctgtatcttggaagtctattcttttctaaggagtggcagaaagggagtggccgtagaggagtgggaggatgggaggaactgggagaagtgggggaagaggaactagaatcaggaggataattttatatatatgtgtgtgtgtgtgtgtgtgtgtgtgtgtgtgtgtgtgtgtgtgtgtgtagatccaatatacatacgcatatatatgtatgtataatctgcatatatttgtataattatataaatgcatattgataaaatatataataaaactataattgtatgagaaaaggatatatttttaataaaagtgaaaaataaaatttttaagtgtactacaaaaaattcagttgagtaaaaaaaaaaaaaggtctccctgcttttcttttttacacagaagagcatatttagacaaaatatcttggaatttatttcaaagtgactgaatgtaaaatgtccagtacataaacaattaatgtctaaatagattcaaatgtttgctatatggttcaattaatccacattttatacactattgtatcatataacccacaaatatgtatgattttaaaaattaataattttaaataattaatttaataattgagaattttatgaaaaaagaaactgtactatcaggaggatgattttatatatatggatggggtgaaggccgtgagtatatgtaggggcagaggaggattaaaacaatagcttctgtccttctctagcacagaaggacagctactgtagatagcaattaactggatatttccaaatgcccagcacagattttggatgtttcaaatataagatatatggttgggatagacatgtgcatacccttacctagtaactgtaaattgtgcatatgtgctaaaatgtcacactgtgtgctactaacatggaactatgtgctgattgaaaataaaaacatacttaaaattatactaatatgatcagagttttgcttaatttcttactattactacttaatagctgctagccatcttctgttactttttttttaaatcacttctagtttgcaaagcttttaacattctctttttgtggttaatttcttacagtgaagggtagggcttccttttcttctcttccataatttcagaagagtgggtctccaacaggtctgcctctgagatagctagattatgattggcttatttaagtaagggcttatcttagatcagggtccctggagaaccagctattctggtttgaatggaaactacaccccaccgactcatgtatttgaacacgttgtcccctaataagtgctgctacctaggaagattatggaaatcctgaggggggtggagcttcatggaggaagtgtgtcactcagggtgggtcttgagtgtttagagcatggtaccacttcctgttcattcggcttcctgaacatagatgcaatagacaggcaagtctcctggcctgccaccatgtctttcctgtaatgtgtgtgttttccctcccacagaactgtaaacctaaacaaatcctttctcctttaagttgcttgtgtcacgtgcttttaccatgacaagaagagtagaacaaacttagcctcctgtttgggaaattcactgaggactgctctcaggaacaatactttcaagtgaatgagggaagcaagatggagcacaaagagatcttgttctgtattaaaagtgctacagagccttactgtagcatcattcaggagtgtggtagacactttgtagtttccataagcaaggcaagtacccaaactattgtgttttgtctgttaccattcactttctaactgtggggtgttttcagggggaaagcattaacttgggaaggcagttttctgtagagaaagagaattcttggagcagaactgtgagccacatgatttgctaaaatgaaggatcagtctgaattttagaactcctcttcatgatcttatttcaacattgtggacactgtgaagtgagaattgttttaatggttggggcattgccttagagtcttactgaaaattatttatacaggacccgtttcagactcatgactcttctgagtattgtggatagagcaatcagggtgacttatcatgtatactgtatctctcctttcttggtaaaggccatgctgcccttacaccgtgaacagcactgcccaccagcaggcactttcctacagctccaagaataaagaaattctaaacaggtcttctgcctccgtttttaaaaaatcagaataattgattatgttctttgacaattttatacatgcaaacaatatactctgatcactttctctccccttcttttatagtcttccaattcctaacaaccccctccatacctgtccttttcctagattcttgactttggttttgttctgtgacccacagtttaaccaagaccatcgttgtgactgattggacctatctattggtgctcagtgaggtcaccagtgggcacacaacagaatgcaatgactctccatctctcttaatctctcagtagcaaatacttcagcattgaggattggggttccttgagttcctcctctacccaagttcgactattgcagaacccattcttatacaaactcaatgcactctccctttttatctttcgttcactcaccttgcccatggacatctggatcatcttttcaatgtttctttatgataaaacaatatcacattatgcaaattctagaaaaacaaacaaacacaagacaacaaaaccagacctatgttaatttccaagtgaagaagagaagccatgctttctagtctggactcgaaagttctctgtattacaaacttgcttctctgtagctttgtttctcatccagcaactgcctcaaacagtttacacacacacacacacacacacacacacacacacacacacacacacacacatatacacacacacagtgtctgccttgaactttagggctcccaagtgttggtatctcctacttcctctgctggaataactcattcaacagtctcttccaggatgacttctgtagcataaggccaaactcagattccatacttgagaggatcctggccactccctccctaggcctctcccccttttctcctgcatgtcctttgtctctcaagggagagttatttattacctgggtgtaactttagcttggtttgtttcattttgtgacacaggaggattctctttcctgagaataatgtcaagcagaatgtcaggtttctggagaagaaagcccatgatttttccattatatttaaaatgacctagagatgtatgtctttagtgatccctgaaaggtcacaataaatattttttaattaaccgaatccttgagtgctgtgttttcaagcacactgggaactgctcacaaagcctaacacttcaagtaatttatgtgagtaggtaaaaaaaaaaaaaaatctagttatatttgaattgatcactgtagaaccacaaaaaaagggggggggggtttacctcctgctcacctttccacttctcaaagcatcttcttcgaattgagtaatttgcatagactgtttaaaaacgttgtccaaacacagtcctggcttgcttctctagcagaaatgaatgtgtgtgtgttctagctcccctttgtaaataatcgcatttgtctcagaagttcaagaagttcaaggttgctcttcacattgtgaaactgacagcttctgtttcatatgcagcaggctggaatatcaggcagaagaaaggctgtgcggtttgggatttggtgagcagagaggataacaggaaagattgatatggcttcatagaagagttatttttaagtacagagaatgcctatccccctgctgaaagggcctttagaaaatattaccaagacagaaaagctgtgggggccattcccaccacctgggatagccattctggtctgcaggctgttgctgccacctgctgcaagcaggcagccatggaggggctgtcacttgggtcttgccacttcagaataacagatgcattcaacgtgtgtggcacagccatctgagaagtgtcttctctaagagtctagatggatcccaagggaaaattagtaaaaatctgatgggttcaggccacagaaattcctaggtattagaatcatgaaccatgaatcaaataaatagctaagacagattggaccaaccgacacccaagtgcctctaataaaccaccttagcaaaaggcagggattctgtgaacagtgaacctctagttctgaaaaatcacactctctcgtcttaatgaggcattctcctgctctctttttaaaagtttcctcattttaatgcagtaagagtctaagtactccaagtaagaattcagtaaattggggtttttattgcagttttacaacaggtgtagtaagaggtgacaaagttcctctccaagtatataatctgtcttcgtctaatagggacaccaagtcacagatcagagtctttctaacacatctcctggaaggctttattaagtcccatcactgacttaacagaattcccagctgcgatgaagaaagatgccctgagcagttacatcacttcctgtcctcccttcaaggatctgaattgctaaccctccctggaaaagtcatcaggaccacctgacttaacatacccaccgacactctgtgtagtttagttctttatggtttttggattagccagataaagctcttagaccttcatttaaaacgcctcctagctgtgacagtgagcaatttccccatttggtctccaaactggtaaggacaaagggtaggaaagaccccctaacttctcccctccacagaaatgtggatttacctacaaggaactagacaataaattcagttggatagctgacattactcccagttattcttcagggtttattaaaatcaaatatgttaaccattgttctttcaccctggggctattcaggaaagaaaatatatcttatgattggactgaaaagctattacaagaggcagcaagctcgtgtttgctaaaggactttgtgctcttgaaaggaaatgtataaaaagcacaaggggacttctctgcacagtttcctttgtttcgattttagaagcagcttgactgacaaagaaactgaaggagagaatcttgggatatggaagcgtcttttaaaggtgagacaggcgcaaggtttcagagaacagtttccacattgttcttgtgaaggttatacttagccctgaaccacactactttcctgtctgcatttcatttcctggggacttgccaagcgatcaacagccccaaccctgtggtagagttgaggtttttgagcacgaatagggtggctagcgtttgcttagctagaaacagcaatcgcctcctgtgatcattacagaaatgctggcgtgagctcttcgggagacaatggggagaaaatggacatattgtgttgtttacaccatcatccagatacagtttttcaggggtaagacttccgctcacgctggtcttttcagatggctgcttagggaccctttgctcctttgaaatgcttcaagactgctgcaggagtcgatcactgaaggacaagctgttgctaaggttgtcagttagctgcttaagtggcagctacgggaaagatgctagagtcgatacaggattcctaatgagcacaaaacctaaggaggaaacaaacagcgccattgctcttgtctctctttaccatttctcctcttcaaagagtcttgaattatgggaaaattgtgtgtcttggagaggaaatgttcctggatcattataaagacaacggcagaaaactaagacaccctataatcatgtccgtggtcagaaagccttgctcagcttttaatcctctctcaggcatttcttttcaaattaacaaacaagtgtctctcctccctaatactaatgtcattagtggttggatttatgttaagcctaactcagttacatacaaggagtaccttgcaaagccaaggggagccctttatgaccatgggaaatgaaacctaaaaggtccatttcaaaatggaaggaggaaagcttagttctgaaccccgcaatacaagattcgtgctgaaaacccgagctatgcatggcaatgaagatcgctagagtttctgaatcaaagacacgttggaactggtgatccagataggctcggatgcatgttattgaagggtcactcctggggagttacattcagatgtataacctctgtctacacaaactctgtgcatccacaaacgtataataattcctatccatcaagtgtctttgtttcttcttagcagcttgctgtctttttatctattcccttgtgagctctgggggacttgtcccagtaatgtattacttctgtgatggtaaatttgaaaagggcatctgaagcatttctgaagacatatcaaaggcccagtgctgaacaaattttgagtggtctgtaccatgcagtcaggttgccgatgggagaaagaacctttcatatctagcgtttcatgagctggttagagatgataccctagggaacatttacctgaggcacctgctcctttctccttgggagatgtaactacatggagatgaaggtcccttcatcctcagagagaatgtcaagtttcttattctactcagccagactgaatgtaggaagcagtttggagttgcgaagttaatgctaaaggaaaactacagatgtgactgattgtgaagagaattcatcttctcttaagggagtccatctctgaatgctctacttcatttctcactgcttttctttcctttttgataagggagcctaataatattatcttatgaagcatgaagatttaaaagatagcacgtataaaagcctcttataaacacataatattttaaaataaaagcccactttattataacagacttgcaaataaagtttgaaaagaaaactattatacttagactagttattatatatgtagatgcagaaaggtcaacagtaagcatgtgtattaacgacttcatgctaagtttgctggggcacttctgtctttaaacagacttaagttatgaggctgaagagggaattcagcaattaagagcacttgctgcacttgtagagattggttccagtgcccacatctggcaattcatatccagctgtaattccagttcatgatggatctgtgggcatttgcattcatattcacaaacagacagatactcgtacatataggtaaaaacataataaaatatcagtcttcaaagatacttaattttattcaccatcagtgaccctcagttactttttggacagaccaacaaacagaaataggcatgtgtcaacaatttcttctacttatcttaaacacacacacacacacacacacacacacacacacacacacagtgtgcaacctataggggcaccccaggggaataacgcaaactaattattcacatctttcctttccaggagtgtgggaagagctattcaatgttggagatgacgtgtatgctctacctggttctgacatcaacttgacctgccaaacaaaggagaaaaacttcttggtacagatgcagtggtccaaggtcacagataagaatgacatgattgctctttatcatccccaatatggcctctactgtgggcaggagcatgcctgtgagtcacaagtggctgccacagaaactgagaagggtgtaacaaattggactctgtacttaaggaatatctcttctgccctgggtggaaagtatgagtgcatctttactctgtatccagaaggcatcaagactacagtctacaacctcattgtggaaccctgtgagtataaacttcccacggaacgatttctctgctttcatgaacctttcattcatttagtgaatacacgaagacagcagacactgtctacatttggtattgaacacacaaagacctagcagaaagaaacactgtctaataagggaagtagcactgatcaaataatgatacaggtaaatgtgaagttgtaacagtggtaagcgttaataacaagaactacgatagttgagagcatagcagagtccagggaaatggtcactgagaaacacctaaattgaagaatgaggagtgaatagtcactactgcaatttagaagaagtgggccattgtgagtgagctagaaatggggtggggacagccatgggaaatgctttgcaaagtttaagaaaatgggaatatgtgagtacagtagaggcacagcgaaggcgagatcatgccagactttgttggttatgttcaaagctatgacttctacataagaatcataaaaagaaatgcaatttttttcaacaagaagttaagatgacatttgtagtttgtgttcatgttataaagagatgaccctggcttcagttggagaatgtccttacagtggacaaggaaaagatgatgggaaaagattagaagatcaactttggctgtccagatgaaatgaaatggcagtctggtatatgaaagggaacatatacattttacatactgagtatagactacacatgacttgatcatagagtggatgtaggacaaggacactgagtgaagaaggaagacactcagaaggcaacactggacttctgctgtgcacacctgcacagtggtgccagcagctgggtacaagatgaaggaagtagagtgactttttgagtgaatttacaaaagtgagtttggatatttgctaagagcaggtaaatgggccatagaagctcctgaacattcaggagcattcagacttttcaggtttcaagggcctgcactcatgatggaatcccgaatttaagctcaatgcccattctgcctagaaatgaagttgacttggaccctgtcatgtaagttctctgaacctgttttggaaattatcctgataacatctggtctacatgacccagttctaaggtaaaatgatttctattcctattaatggagacagaggacaataaaaaaacagcaaatggaaagtacattggaaattgaatgtttgaaactcagaggagaaatagcctggtaatgtgatttaaaaaaataataaacaaaaactagctccggaaaggcttgctgcaggagacgtggggctgccctgatacacaacaggtatggatttctcaactcctctccacatctaactcttgctgctctaagacaacgatgttcagataatctcaaagtgaggtccgattgcaccaaatggagcaaaagacaacttcagatcagttgacaatggcataggtggttaaaataaagtaagacctttttaaagctacacttagctacggggactttgaattcaggtcatcagcagtgaactggatgtgtcacttactacagacatcactgagtcccactaagtaatcatttcaggtttctacgctttggttcctcacataacaaatgtatatgatcgtagtccctcctcgatgggtacccttatcttggtaattaaataaggtaatctgtgatttttcacacttactacactttctattaaaaggtatgagattggctatagaactgtcttagcctttaaaagcacttgtttttcttgcagaggacctaagttcaattcccagcatccacatgatggcttacagccagctataactccagttttggaggacctgatgctttcttctggcctgctcaggcaccaggcacacatatgtatgtgtaggccaacattcatatgcataaaataataaataaatatttaatataaggtaggagttttgcaaatgattggtattagtagtagtggtggtagcagtagtagtggaggaggagtagtaatagtaatacaaggagtaactttatttttcaattcttattaaatttaaattttttctttgtagagtcgtctaatttggatcctcattggattcgtgaggtattgtcagacatgaacacaaatatatcttgactttggatttagacatagttttggtatattgtgtcaaccccaatagattatgctatcacaactctgaggatctgatcaatactccattgagaaatagccatatgattgtatctgccatccctgtacttaaaagactaccaccatccatcatttagacatctggggtctatgctataaaaatgataatatactatggttccaatgaaggcaagaatggaaaagagatattattcagaagtgagtgacactgactttaataaaagagagagcaatacaaggtgcttacgtttgtatccactaaaactgtaaataggtggagaatcagagccacatttatgttttctgtggttggaaaatttccagtctttttcctgagcttatgttgttgatgctccagatcagatgggaaacaacagtgttaagacagagatttactcctgagtatccagtacaaacagatcacaatttattaaaaaaataaaaacagagaagagaagaaacaaaacaggtacaaaaactgggacttaaagtagaactgaggagttactagaagagtagagaaagtgtctgttttctgacattgtgaacaagtccccacccaatggcatgttatctttccactgcacccattgtatcaagttctctgttgagcttctgcaagacattcgtgtttctaagccagatgagtaagtgagccacacatatgaagtgtaaaaaacatttgaagaatgtgaacaagtgttaactcaagtgattcaggagagactaggagacttggagatggcgaggttcatcacctcttcctatttcctttctcttgtcatcagagtcgttcttcctggtcatttacaaagccagaagtatctaaatcctgttcttgtgtcccctgagggctcaacgaagaaagacagctagctgatcccttttcataatattttgtccctgtgtatcttagtgtgtgcagaagctgtggatataaatggaaatatgatgaataattaatttggtatttgctttattttcatttcaatttaatatgtttctccatgaatcaggagtcttcgggttatttgaagaaacatagctccctgagtgagtccttggtttataataatctacatttcagaaatttgagtgctacttggtctatagttcttcagatagtactttttaacctatgggggaagatgtagttgttacagtgaattataagagtacagcatagtttgatggtttcccaaattgccatcaaaacccagaggttgttaatgttaccagaagcaagggtggtagagaaaaaggtagataaagacagagcactaatacactcagtagaaggtgggtttgtattgtagctcagtgacacagtgtctgcccagcctgggggaggcactgagttccatcactagcatcacaaggaaaagcagagtgatgatagcaatgcatagaaactttctaatcttggaaacataacgatgaacaattgtagttgcttgcacagatcaaactggtcaacattccagcatgcgtggggaaagccaggcaagctcctactcttgctgatactgacagttgacagcatctattggaggaatagtcagttttctttaagatactgggccttggtacatagattatgcataagtgaatggtctcacacctatatgtaaatatgaacagcacaaattgggcccttggttagaaaaataatttagaagagggcacaaatgtgagaaagaaagtgggaggttgataagggaggtgcagggaatgaaaataattaagacactatattgtatgtgtccataaaattcacaaaaacttttatttaaatcttaacaaatattgttatattaaaattaacaaatcattaataaaatactataaaaaagtaaatgaacacagtttcagaactgtgaagagagaaggatacaaaaaggtagaaatgtgggcaggcattaaataatggcagcatatgaaaacttgctagtcaagaaatacaccactatgattctaactttatcaccatttttcttttaaaatataaaaatgtcaataaaagaagaaaattcattattaataagctacatgtggctaagttctctgtaaattaatttgtcatttaacctgaatagtgactttcatcaatgtcttgtgtgcagtctttgtccagcacataatttataagagatattgctgaatacaagggactctgggttagatgtggcaatgagggatgcagacaaggtgacctgcctgccctgcagcatcgccatgcccagtagaaggaacagatatcaattaagtgttaaacagcaacagtgaggagttctggtgcagggagaaagtaggcccaggtcagtgaagcctagaaagaatgtcctggggaattcaggaaaggtttcctagagccctcccatcctttggagcagttattaactaagagatggaagaccaagaaattgtcattagcaaacaggctatgtgcaggctctgtggttcaggaaatgcatcaaccctgggattctaaaaagaattatgactagagcaaaaagaattcagttaaggccactgaaagcaagattagtgtggtcaagagccatagaaactagtcaaggtggttttctttaacacttttcattttgcatttcaaaaatggggtgctttttgtttgtgttttgtttgctttaactaagttctagggaatgaattgaggaaaagcagaaaggatagtgtaagaaagtgatataatatcagaaatggaaagaagatattatggtaattctgagtataatggcaaagagattgatgtagagcaatatctagacaggagccatgtttaagtaggccatccataatatctggtggtatatcacatatatggcaattgaaattcaaagcatgttactttgattttcagaatatattactcacttgccgtgttaggggacactgtaatctgaccagatggttcagagatcattcaagttctacatcatatgtttgacttaggcaggaaagttgagaataacgacatgtacacagctggctatgttgcccctcagctagcacagaaacctaagtaaagataccatgttagtacattttctgagcatagggtacaactaaatttctaggtgtgaaagaggtagtctaggtagagaaatcaaatgagaaaagacatgtagttagtgcttcaactcagaggacagagacatgagtggagtgatatgactccacaggacatctaagagtagattaaaaagccaaacaagagtgagaagagagaaccaggtcagagaagcctagaaggataattgcataaaagcagcatccatccatcctgacacttctgggaaggccagtggttattggattgcatttaggagcatgaaaggtattgaccagttagttcaagcttgtgttggtggcattatggaacagaaaagaaaccggatggaagaaagaacagggagtgggagacagggttgtggggacagcaagtattgatgcagcttctagccactgatccatagcaacagaaagactgtgaatgtttgaacgaagctttgtgttggtttgtagtgcgggtggtttttaataattcaaggcaccttactatactccaaagccaatgggcaggatatacttaaaaagaattaactatatcagagttagtaagaaaatcaatttttctgagaaaacagaaggtccttaaatccttaatatataggaaaactattcagaaatagagaatgcttttataatgtttgtaacagcatacattatgtttcattttgacattttatacacgcatataatatactctgatcatattcacccacaatgccatctcatgtctccctcccaatcttctagtagccttttcttcccaactagcctcctttatactttcatgtcttaacaaaactcttttaaaggtataatagttgggaagggaaacaagatgactgcttttcagttccaggactcctgttttccagcaaatgttggccaatatcttagtattttctattcctccaggaactctagaaggttgaataagatacacagagatgcatccacctagacaatagtcatgcagttctgaatgtcaaagagaaactagcaaataaaataagtaaaacatagaagcataaaaaacaaaaaaacctcattccctatggctcaccaataaaacaatcaaaagggactcttatcagaaacaccagaggtcagaagacttgtccaaaatactaaaattagccacagctcaccaaggagttctatgtctactgaaagtatcaattcaatgtataagaactgaaataatctaccataagcatatttgtcctcttaaatgctagagcttgaggataacctccttacattacagaggccaggcactgggaatggattaaagtcactagagttggattcccatgctaacagcactcataggacatgtaggctacagtccccagtgttctctccccaaaagacgtgctttctcagtcagtctagaatatgtagacaccttacatcagtcctcaagaatcctgttcccaggtagtctacactaaatgatgtactggtccttagcaccccaccacaggctggccagtgaaaataaaatgtattctctcattgttctggacatgggaaagctaaaatcaagtcccagtgtgtggtaaaatctttctccatgaccaagggggcaggcaggtgacagaatgaagcgccaaaggtgagaagcctgagcgttgctgttgttttcatggaggcaatagaagttttacaagaaaagtatgctttttaatttcatgtcaatgctcaggggtatgaaatagctatatttagcatttttgcccaattttgcccttgtcttttattttcctcatggacctcctttttccctataagaaaagccagtctctactttctattcattttctagacctctattgtgtacccactagacctcttgtaagtattcacatccttataacaattattagtgaataatcagccctaactgtgagcctttctgtagtcatgttttattttaaacaaatttgcaaattatggtttttagcatttgtgactatatatgtacataccatattatttgaatatcttattttaaaattatttatctaaatatttttctcctttgatttgtaaaatttctctcagtgcattagctcttgtgcgcatacagcttccgctttgttctaaatttgtctcattcccagagtgatttttgaaaatgattttctgacttacatcgcctatctctcacgagtcatcttatcttcagtgaactcatttatcagcccttcccaattttctacagtttatgtcgtcttttttctttcaactcattttgagtaatgaggttgtagcttttatttgtgtgtagacatgttagcactctgcttttgttgttacattaatggtattttatcctctggcctttttctcactgtagtttaacagctcattctaccgcaatcattcttctactgcttgagtgtgttcttatccttaccatggaagtcagcccagctagctcttctgttgcctttgctgtgtccagagccagagtctgttatctttgaggaaccccaccgtatgctgccgggctgtcgaggtgggcttcctttccttctgtctcccacttttatctggatgtcctctttgatttctcacagtgaatccatctctcttaatctgaattcttctcctaagggtttccacacagcgctgaggacattccaccgggccatctgtcacagcatgggggacctagtctgtttcccaagaagaaactggcaatctggggcctgcatctcccttctccgcctctgctgttgttctcagattagccagcctgtctgtgcagtgatcaccctcaggggagcagatttctctgttctaaagctcgtaggaaacttagtccattttccttttttcttttcgaacagttgctattacctggtctggtagtttagttatagtttaatgttcttgtagatattttctaggtgattttaacttactttctctgtcgttctcagttctattttagaaggatggaacctcaagatggatggactgatttggggttaaagcagaagagtatgtcaaattttgagttgggttgttaaataatttcgctgtgagttttcagtgatgagtaattgcccagacttcccctggttcagttttgccatttaaacaaggactacagtagaattctgcctccttacttcataggtgtcttgaagatggatggatctctattctaaactttttttttgtctctttgataaaatgtactttgtatgccgagatccatgaatcttccaccctgtgttttgttccagatacacaagatgaacacaactatacaatagaaatagagacaaatcggactctggaaataccatgctttcaaaatacctcctcagaaattccacctaggttcaccttttcatggttggtggtaagcgttgcccttttcagtgaataactgtaatgatctttaaatattaatgaggtgaaatgaatagcaagtaataatagagaagaacttgatgagacccaggcattatgccaggggctcaggaaggaagtaaagggcaccaaggtgtcttctaactaggcaagcagcgatgtatgcagtgggactctgaaattagctcctagaggtagatttctatttcaaatgataaacctgaccatgactgcagagagaacaaggtgtgatgctgccccagtgaggaaccacttacagcagcccctgagcacagatgtttgttttacaaataacatttatagagatatagaccccatttcccagaacctgcattgccacaatcctgcattgctttaatcaagaaatgcaaaaacaattcaatgcttacaaaatacaagaggaggagtctggaaagatagctcagccgttgagtgcttactgctctatcagagggcactaataggcacacaaggaatccaactcaacccctgtcttctgacccccataagtgcctacatacacatacggaaacacacacacacacaaatatcttgcttaaaaacacatctgtgtatgggagaaacaggcttcggagaggctcgttactattcaactctcttactgaggcaatggctacaagaaaatagaaaccatgacctttagaaaccactacaaggagccagaataaggacttttaaaagtttcatgtatttatttaattgggggttgtgtgaagccagagaacaacatttaggagtcagttctcttcttccatcctgtagtcccagggacagatctcaggccacctatttaccatcttcatactaaatgggtggtcactacacttgtgctgtttggttggttaatgagagccagctcattatgtgtcagatattaaataacttagaagtctcctttatctagcagtgtccttcaaggaaacttggaaggtggtataaacattttgtattgatcccgtacagacatttagaacaaatgagggccagagaggacgtgagctacctagagcaagatgataagtctaaaccatcagcagaccctcaagacaaactgtcattttaaagaacagattgtaataatgacaaattgggagatcccattgaaagaatccttcctacaaagggaatatcgtgttggcaatatgctgtttccactgtgcactctccttttaaatgtcaaaatctgtttgccttgctgacctatagccttgccctaactacaaatggctccagaatttactaagtctggtgtgaaaacatcttatgtccctatattaagaaatagaggcttccccaggtcttcattgctgaatgtcttcagaggtgacacagattctcacaaacaggaaataatgtggctttaagtaaaagggtaaggaggagaaatgatgaagataagctcagccggcaggaacctgctgtgctgagccccgaaactctgtggagctgcaatgaaaggcctcctgcccggagtgtttcattaaaccctaagaacggttctgaagaccaaaatgacccaagtccccagaaaataaaagtcatgttgttgtgcatgtgaaattctaaaatctaattaactcagttggaaacctcatgggggaagttattattaggattctcaatatcattggaaaatgtacttgctatgtgtacatggtctcatggtcagctgtgtaaagtggagcagatcattccctttagggagttatatttcaggactgtactacactgaattcaataggcatcggacacagtgaatctaacattcagcagctgtcacaggataattcagttacctaagaaagcacaagcatctatgtgaacagtggagtgatatataagaaatcaaggactatgtgggtatagttgagatatgggtgggtagataaatggcaaatgctaattttgctacttaattcctaggacacataccagcatcagggaaatccttcaggcttattctgggagtttctaaatacattctaatattctgttttcattacaaactatcatcctgtgatttcccacagtataaattttaattcaatccaataaacagatgtgactctgatttgagtgttagaacccacagggatacagactatattagacatattttctatcatgtcatgtgtttttaataaaatgtaaaaaagaataggagtgttcagggaaaacaatttatcagataattccagaaaagctttttgaaaagttatgttggatcacataatagaagacagtttatagcaaaagacagacacatgctataacaagaccctggtagtcatacatacaaactagtagtatacagtggaaaatatcttagggaaatatgtgatcccacagtcaatgaactaaacagagatccttcaccactgcttatgagcttacagtggcttgtggttgcctgcataagacttgtagaagaccaaggaagtcagcattctggcatggaacaggagatgcttagaatcctatacccctaactgaagagcttgggacagctaaaagcttctgtgtaaatgagaagttggttctctttaaggatgtgacttctagtagctttacctccatccagggatggccccacacctggtagtccaggaacagcacaaattggatgcaatggattgttttttaaaaaaacacagaggggacacaaggttgggggtgtgaagcggtgaagatgggtctgggagaatttagagagaagagttgtggtgaatatgatcaaagtacttgtttgaaatctttgaaatcataaaatatattttaaaatcaataaaaacagaaagaggactgtctaaatacttataaatatacccatagattaaacagcttttactgctcacgagggaagcttcttttttgccacggagacagaacaactagcaccaattataaatgactgtgaagtgcccagtcacaaatgggacatctctaacataccaacttctcacaaggctctgggagcatcatggaataagggcagaaaggctgttgtaaaagtcagaggggtaaaaagacttctgtgaggtagtgacttctgcatatgatatgacagggccattgcacctacaaaatcacaatagctgcaggtgactgcacaaggcatccgcaggatcaagccagtcaacattccgcatggatgggaaatgaattaatgtgtccccactcccaagtgaacagttattggcacttgatgacttctgggagagggttgatgggttttcttccgggatgcggtcccgataggttgcccacgctctaaagggcattaaaggacatccctaagcctatatatatagtcagcactagacttcatgagttataaagaaggaaaaggaaggagacagtaaagcagaaggagaaggaggaagaagggagaagatgaagaagaacacgaatgagaagaaagaataagaaggagaaggaaagagaagaaggagaagcagaagaagtagaagcagcagaaatagaagcagaacaaggcaggaggaagagaaagaggaaaaaagaggaaggtgtgagggacaggatggatggagggagaggagacattgcatccgagaggtggaagaggggtacatagaagcaaaatacaccattacatatatgaaattctcaaataatatgtgtgattggatgtgatcaaaatacacagtctacatatatgaaattctcaaagaatgaataaaatgttaaaagagcttcagatttttctagttcaaatcatgaagggggaacaggacatttaatattgtttgtttcatcatagttttctttagtttttgcactgttttataatcagggaaggagcaatggtttcaggtgcatatatgaaaccttgtgatttagaaaacaacatcttccctcttacccggtggcagctgatcggcattgtcctgggtcttatcaaaatacaaaggacccgcaaaacaagtatggtactgtatgcctttagtcccagcatttgggaagcagaggcaggcagatctattataagttcaaggtcagccagaccgaccaagcaagtttcaggacagacagccaggactacaaagggttaacagctagtggtggttagagatactcatccttgctcctgaaaataaatgtaaggagtgttgcaagcagcctgctttgacagtgctgccaggtttgaccgtgctggcagggtggagagtgcgtggagaaaatgtgaagatgtgaagtacactggagatagagaagcaggaagcactatggtaagcaatgaccatgaaagagctcagagcacactgcacctgccgggtgtctgctcaatgcagcccgagctaactcggagctggctccaagcatctgaagccaaccagagacaagaaagaaccactaaacgtaacagcaccaacggctctctgcagaactggaaaccctgatcccactacaaaaaccgacaggcctcagcactaactgcagacaaaggagtatgtagcaacaatgttccgtgattcaaaatgacctatctagtctccaccaaattttgttaccagtttgtacataatttaaataaatagtcacatcccttcttggagccttgaatttttttttaacttttttcttgtgaagtattcatctcaaacagactgcaagcagataaagcaaagatagccctctacctcttgtaaggttttacataggaaattcactaacagcatggggtttgagagaaactgctatgttcaagtccttactggctgtgcaacttaagggctaaatttagggtgagatgtggaaggcccttatccatgaaagccacattcaggaatgcaacacaaatcagaaattgtggagcaccacgcgcgggaaataaagaggtaggagacccgtgttctaccagagctcaggtagactactgccggaccccacggagcgtcgggcctcataggctgcacaaccccgctccaggtggtagggtaggcacagtctcggcttggactcccacagacccgctgggtactacggggagccggttttggcgtccctgggccattgtctatgtgactgatagtcacaggattatggagttgaggagttgatgtggtgtcaggcgcttgtgtctgggagcataggttaaggttccgtccctcgtagatttttctactgggtctccccagtaagcctcgctcgaccagaacacagactgcctttcacggtccaacaagcaatcaatacaaatactttaatacagcattttaaaagaatataaggaaagcgcatggtgaacagtatcaaacttttaaataaagtcccacctttggttatttgctatgagatctcattatatttatattactggaggaatagtatgttccaagcaacctgtggttcttgagtcttcgaggtaatcatgaatctggtcgtgggttaacagaggcggggtaaacagagctgtgcatggctttataactctcatagtccgctgtgtgttactgtcacagggcacctgagactggggagttgatgaagaacagagacttatttttctcacaatcctgtaaggcaagaaatccaaaaatcaaggtgcatggtttaagggactggaccctctgcttcagagacggttgtttgcgtgctgttctacagatgacgactactatggccctacatgacagaagactggaagggtggaggacaggaaatctactcccacaaacaccattttgtttatatgcttgttttgggtgtgaccttttctgtttggttgcagttttggtagtgttggcagtgagctatgttctagacccttcaaggtctcattcttgtgggaagagatttcataggccaagtgtctccatctgggcagcactttcaacactgtgactctgggaagaagatttagaggtacaggaacaaaaccatattaaccatagcaataaccctccaaacttcccatttagatggggacaacataaatgttcataaaaaccacagagtgtttgtgggtacaactagggaagagtgaacttagtgaccagctattaagtgtgtggactatattgctagttagatttatatagcatatcaaaacattttaaaggtttatcaagatgtaaacccataaagtttttgaagtacttattaacatttttaaaggtagatattttgttctctgaaaaacagaaagaaaaaaaaagtagaaataaaggctgtctgtgtgtggtcccctgccagtctgcctgcagagcaggtcaactgagattgtttatactcaatagcagttgaaatatgctgtatgttgcaggccaccacaggtgggtctgtataacataaggccctatcaaccagcatccagccctgatttctgtataaagtctttctggaatttgtcctaaatttctcattatagatatgcccaaagttttatatatttttaaattatctagtggttcagatttgttctgtatgtatagtcctgaagcatgattttccttacttctgagcatctatgctttaaaaccctttgatatgaggaccttcttattctccgtagctgcgggaaagttaatttcctgaagactggagtaaggggtataagataggcttgaataaactttgcagtgcttcgaacatagagtgcactaaatagattaaagcataccaagtggttatccagtaccaagtggtcatcctgaaaacatacatatgagtaacattctataaaatgagcagagtatatgaatgcattttggaatgtatataatataatatatgtgtaatatgaacatatatttgtgtaacaataataaaaatagaggccacgaattggaaatagcaaggaagggtatatgggaggctttggagggaggaaagggaagagaaaagtgatgtaattatattacaatccaaaccaaaagagaaatagcagtttaaaagtaaaaagctgtagtaataagaacggaacctttcagctgtagtcacagtgtgcttatagcactgccccctctcctagctttagatactgggtggtttctctgaactagatttgcttccccttttgctctgtgatgcaaatgcaggtttgggcccctggagggcccaatctacaatccctcaggatttccttctgtcacatgcctcagggcacgttgtagctgaattccacctttaaaaaacaaagctatcctctccctctgcaactgccaaatgccaagggaaagcaaataaaacagaaacctgttagatacattgctatatatagtggtatggtatttttatgaatcgaactatcagagcaagtcctaccttgatttacaatccaagcaaaagcattttcttaccagtctccaccttgtgtataccctgtgcctctaacaatgtgacagatggaaatgtcccaaatagaaaacccacatggtgaaacaagcaagaactctttaaaataacctactaaatttattctttaaggattccatacatgtatgcaatgcatggtagttaccccccacgcacttgacccttcttatttccctcccacccggtcaaccctctccttacacaagatccgttcccacattcatgtctttttgcttgagtttctgacccactgagtttaacaagcactatcggtgggactttttgtctggctcatgaatggttacacaaataaagacaactactacccgtccatcaaaatctatcagtaatcaatagttcaggggggagggattgggtctgttgactctctttctgactcatgattgacagttcaaaggccaagaacatattccatttttgagattataatgtaattacgtaacttgcctcttctttttcctccctccaacccccaaccccatatattcctccttgttcattttcaaatttgtggcctcttttttcattcattgttttttgtttgtgagcctagctgttttattgctgagctgtctctccagccctctttttacgttacttgatgttacatgtgtacatgtttgttttccgggctagccgtttggtattggataccccatcagtatgctcttcctcggagaaggttatttttctcattcttagagttccttagtttcccatagttctttatgtaggtttgaggcattgtcctcttccccgcctaccctgccctgcctattcttgttgtcctcgttcaactcatgtgtaggcaatcatttgtccctatactcacagataagcatagttctcacacctcatgaaagaaacttctccttgcaacagacagagacaaatgtagaaagccacagccaatcaaaatgcagagttgtagaatgcaattccaatgtacacatctactaaggactccagacctaagcctcagggaacgttgtagaataagggacagaaagtcagctgtgaggctgtgtctcttagtaatgttagaagctattcccattaaagtctctccaagaacattttgaactacaaaatcattataaaaaccagctgtaagaagtaccttgtgctgacggccctgcagggggagccaacttccttaactattaccttcagatctgtggtgttgagggaaaagacttctacttcattctgtgggtactcagggctctcctgtcttgggaatatattctccctttgctcttcttcaaaaggaagatgatgcctactctccaaagactgctttatgaagctgtagaagtgcatagcttgcttcaggggggaaaggtttatgcaggctgaagttctttgcaaggaaccctagagtttcattggtatatgacagataataaactcagccagattcagccaaagagttagggtttgtataagaactgctatttagtcgactggaaatttctatataattactctaataaatctgcctgtgccagattcactcaccagccttgattctccttctaccccgaatctagcatttttaaactagaagttctcagtcacagagagttgctttcattattttatatcttctcgaatgcatttctcttcacctttctcccattagtttctcccattgcccctgtgcataatgacggatctggaaagtttagagttagaccaatgaaagtcacgttaatgtttaaatcccacttcttaggagttcccttcatgtgcaagactctaaaattgttgctttccggcattcattgctctgttgcctctccttcttcctactcctgattctgtatttctcagagaatgccgggaagagaaggtaatgtggaaatatgaagttgtcgtaaaagtctaattatcacaaccccagtagtgtccctagcacatcttttaatttttgatgtattcatttcttatactttacaacccaactgcagtttcccctccttcctctcctccgagttttttcacctgcacatctacccccctatccaatcgatcaaaagggaggagtggctccccagcgcatcttggcagtgagatctcagaatttcttaaatgagcactggggtctgctattatcactctctcctgccatgaaagcaagacccgtttaggacaggtttctatttgtgctcggagaggatgagagtggagtttattaaagtgtaagcacagcaatactttctgtagtagcatactcagtctctccccattttaacgcatgcttaacccattttaaagtccctgttgctcttccagaggaaatggtacattgggtatctcaaaccagctctagttccagtgaattcgatgccttctttgggcttccctaagaatctgccctcatgcgcgcctacacacatacacgaatgcgcataatttaaaacaaataagtagtgttaacaaagcagtcagctgagaggcacactgacatattctgtgttctataactgagtgctgtttctctctccaggagaaagatggagtggaagaagttctcttcacccaccatcaccacgtcaacaattccacatcatttaaaggcagaatcaggctgggtggagactatagactccacctctccccagtccaaatccaagacgatggcaggacattctcttgccatctgactgtcaatcctctcaaagcctggaagatgtccaccacagtcaaggtttttggtaaggagtttgtcctatgatctctttgccacctttgtgtcaatgcctctggccatgctcttctcatgagaggggcccccacccccaccttggccccaggctggagagcaaccacacagggtaactcctgcaattctgtttgccttaattcctatcattctcattgagggtagggacaagggtggaaggctaaagaataattattcagctaatagaataagccaccagaaaaccacatataggtcagcttccctggtggcctctaccttgtttgcaggcgtaatgtttcccaagggtaccagaaatctctttaattataactgccaacgtctaattgcttggctgtctaattatctgagttattttctggtgcaaagtgtaataaggccacaatgagtaaaagaagctgataaatacagcccgagaaactgcagaaactccacagccatcctgccagggcccacttgggtgagaggccaccacaggcttctgacagtggagcccgcagactctctgacctgatcctagtgccactgacctgggaaatctgccacgacctcattcagagtgtagacacactgtagggtgtgatctgaagagaaaaaaagatataagctctgtattttgttccctggtgcaagaaaacattactaaacagagactccaggctttggctagtttttcattttggtgaccttgacctgcagtttttaaagtcattctaaaggagggtaaagagaaaagcagccatgtgaatgggcaaccaattggtttttgtttgtttgtttgtttgtttcgtttaatgaggtgaactaagagaaaataaactttatacaatgtaagggcacaggctgctagatttctcctcaattttctaaatgacagagtaggcaaagtaaaataaaatacaaaaactttttttgttgttgtttttgttcattgcattgctttattgcatcagtggtgagaaaacatggtcagtggacgaaaacataaagtcctttataaagacagaaacagctggggcatgattggtttcgtgaggagttcagtgcagatagcttttctcccatgcctcattgtctccttgcacacacagtcccccctttctcccctcctgcccttccttttctgcttgcttcgccactcttctctcccatgtctcctcaggggatgggctagatagtcatcatccatcaccattggtttcccatgaagatttgagaacaggctgctccttgctgttgttggatcaataacaccgttggttcacttccagggtgtgacagtcttagcgcaaacacaaaaccgactcatctggccttactcttggcaagccagtgagggcaggcatccaggctgtgggaagaaatatgcattttaagtcaggcgaggtctttgtgccacagcatgctctaattgccttgtcaacgtacataccatgtctgcgagtctttaccgccctcagacgtcttcatattggttcaggagatgggagacatatattcttacttcccacatttagcatgtcctctgcatctacatccctctgtctgaacttcttctgcacttcttctttaaactctgtttttttggtggagggtgcttagaactatggaactctgcttgcttattttgtaatttagcttcaattgtgtagtggaattttttagtaaatacactgagtttgtggatgtgctattagctgcaaaggagatgtgggtaagactttgctgtacctctgatggtatatttatttaggttgtaggtatgggaaactgattcaggagaatagtgagtttgagcccttgctacagagtgaaccggtcagtcaatggataatagaaagtaaataaaacctgcttttcattcaatagggttttcctacatcaaaaaagccaaaaccaaatttaaaaccttttaagtaagtggtgaatgtgtccccaatccaaccatcatgcactccacccaccacctagtttttcttcccaagccatctctgcctcatctgttctttctgtagagtgcagaccagaggctgggtgtccatttgcatcaaccaccaactcactgctgaggctttgcttgctctctcctgctcagaacctggaaatttgaatatttagagctcacagctacgtccaggacttttaaggtctctcccccgcacctcccccccgcccccctgcagtgccttaattctatttacatttgtttcttataagaactaagaaatatccttttctccatcaaattcaggactgtgtcttggtttggattcccccaggggaggaacaaagagtaaaagaaggcattgagttaaattaacttatgtgtagccaggcagtggtggcacatgcctttaatcccagcacttgggaggcagaggcaggcggatttctgagttcgaggccagcctggtctacaaagtgagttccaggacaaccagggcctcacagagaaacccagtctcggaaaaaaaaaatgttatgtgtgatgggatcccggtgcagaagtgaaggagtagagaggggctcctactcctagataattcccaagaagatatctgcaactggaatctgtttgcaaaggaaaaattggtttttcccagtgaactctcactggctgtattatccacaattaagggcaggaccccaagcccagcagtagctggacagcacaaaacaaactcaagggttggtatctttgaagacttcttttctcatattagtttgatttgggcatttttgggggagtcttactggtcttttgtttgtatatttcagtttctgattttctgcttttgtggctgtgcctgtgtgttattgtttttgttttgttttgttttcttttgttttttttagttttggttatttgttttgttcatctgactgttttctaaaggaagagaataaaaggctgtggagttaggtgggtaggatctgaggggttggggaagggaaaatatgatcaggacatggtgtaagaaaagttaactccaattaaattacatgtggacactagaaatagtcctaataatgatttgcaaagtcaccctagagacacagcacaggggagaaacctgagcccaagaggggaaggaggataatgtatgtgcataatcataccagttacttcttccagcctgaagatcagtcttgcagagagctctgaactatggcacagaacacatatcaggggctggtgaggtggttcactgggtaaaaaacacttacacacaaacccagagttctggcctgagtttgattgccagaatgcaaggtggaaagagattcaaactcccaaaagtgatcctctgatcaccatggtccttatgagcaatctctctctctctctctctctctctctctctctctctctcacacacacacacacacacacacaaacacacacacatattttattaatcctatttgaggtctcaaatgcagggcaatgaagccaggatattttccccctgacttcccgtctgttacattatctccttcttccttccctcctcatattctcaatgaatccagaggcaagggatcataaataggcccagcagcagctttcggcaaccagaagtcactgctgagcaggcaggcaggtaaaccacctgggacaaagaatggcaacagtctttcaagaggttcatagaaggctgggtctgctgctgtaacaagaacaagctcggaggtgcttcagtcttcagtgtccatgcgcaaagctctggtgatgaagacttccaggaacttgcaatttgtagcatggcaacaaaaccatctcctgatacgtgttagtgccaagcaagccaaacagcaatcaagtgtttctctgattccctcagggttctagaagtgaaacatttccttcctgcacacacatccctttctcccagtggatttctttcctctattctagctgccccttctcagacttttgaaaaggcaattataactactcttcccatccatgaaaacactaaatttgtatgtatttttgtgtaccatggaatgcttacacacacacacacacacacacacacacacacacacacacacacacacatagtatagacttcagtgacactaactgtgccttatttgcttttaagctaaaccagaaatcctcatgactgtggaaaacagcaccatggatgtcttaggagaggtgagtcacagcgaattctttgaatacccatactattacatgccaagctgtgtcagattgcctggctgccaggaacattccctcaaaagaccttattccttggcccttagccacttaactgctgctgtgaaggcaagctgaggtgactggaaactgcagagaaatcctggctttgacttactgctctcagaaggcgtgggctgaggccttaggtcttactttcctggtgtgtgtgtgtgtgtgtgtgtgtgtgtgtgtgtgtgtgtgtgtgtgtgtagaaagggggttcaattgtttaaatgtctctgagattaaaaactgagggaaagtgggacaaaaaccagtgtgagtcctggtggaagttgacttttaatttgttattctcccgagttctccttcccattgccttgagaagaggaatggggccctcccgtcctcctcccaaacctgcctatttccctggcaataagagaaagggcgggagaaagggagaagcagaacacgatgctctgagtttgccccttcagagtagctcttggcctctagtcactgcatccgaacacattacttcatttctctgtagtcagttctccatttatatgacataccaaataataatatctgcttgttgtggtcaataatgaaatcaatgtctgagtaattcttaaaggagtatgtggcatgaaggaaaatggtcaataaatattgctgctgttagcaatgctattctggggggagtgtggttttggtttttttgtttgcttttggttttttggttttttgtttttttgttttttgttttgttttggttaggttttttaatacacattttctttgtgtagcttgtgctatcctggaacttgttttgtaaacctcacactgcctctgaatcccaagtgctgggattaaaggcatgcaccaccatgacccacaacactattgcctgttttaatttgctgtcttgtgacttcacctaagcttttcaaaacccaaagtaaaataaacattctcatgtattttctgttacgtggtatgaaaaaaatatattttacctgcttttcaccctgagaatattatgatttttgttcttctggatatcagtaatgtagttccatagcttcgtataaaccataactcaaattctgtgtgttgaccctgaatgaccataacatatattatccaagtatctgtgtctattaattggtattataatgtttaacataataaggacagatttaatcatttaagttctgttccaattaagtcctaagtttatcaatgggcttcactcattttagtggcttcaataaaacaaataacccaacaatacagatatcaatagatgtttttgcttcttcttagaacctcttgcagatgcttggagccagtgattctgagtaagatgacatcagagcagatatgaaacaataaaatcaggtccaagaatcccagctgaaaatttaaaaaggaatgctccgccttgcatttcacaagtcgtaaaatttccccttcagtacccatgcaagttggctggggaaagaaggggccaggcatgattccctgagaaatcagtgaatatttatctctctccagcttcatgtaaccatggcaggtcttgagatgcttgaaaatcttgccaaatattactaaacccttactctaatagagttctggtgctatatctttaataactcactaactattccaagcattttaatatgctcttgttttgctttcagccaggctccaaaatagagcatctgttattttatagatgggaaattaaagcctgaagcccagaatgcttggctgagtaactaacaagaggctgagctggaatgcattgaagcatacatccagggaggatgggacaatgagaagaagtagtgccttgatcctataacatgcatactgaagtacaatccaactgttactggttatctatccacagcaaatagttaaccactgtgagcctctgaaaccttgggatagtaaatatttgataagatcattaggaaaattagttatacacagttctggagtccatggcccacagtagatatctcaggtatattttccctaatcacttatgaatctcactcacccagcttcaccaattccttcttctgcttgtaccttcctacatctactctgtgatcaattctaggatgcaaaattagatacagaaatggaaaactaggacatggtagaacgtgctggaactgggtttgacttttccatctaataacttgagaaacttaaagccttacttccttatcttcttcatccgtgaaagggggcactggctgacttcaacttcataagggtggtggaatggtcaaatggtttagaaagcacctgtcacctggtacccacaaggactcatagtaatttcctatcctctaattccccaggaaggaattaagttagaatccatgtactaaagacccatgcttaatagtcctcagtgtaagattttgctggggactcagtctgttataagctatgatacagtgttatttgtagaggaattttaatacagcaatatggctgctctgcaaaggaagcatatctaaagaccttctaagtctatgtgatctggctgtaatatagaaactcccttactgcacacctttaattcctaacaatgaaggatgttagtttgtagaaggaagcagccatgtttgcaagtgatgtctaattgagaggcagacaaagtgatgaattacagaaagatttgacagactgagtctgtcaaataggatatgcccgactcacatgagaacagtacaggaaagagaggctattaaagagcagggcagggaggtgtgtgtgtgtgtgtgtgtgtgtgtgtgtgtgtgtgtgtgtgtgtgtgtcatttttactggacagttttacagaaacagattacagagagaacaagctagacatgggtagatgaagacagaacataccggagaatgtgaagaagccaaaagattagaacatattgccaaagttagtatgaggccaggcagagcaattcagtgagcagccaagagaagctggattgaatcagtcaacttggaagattaggttgtatggagtctagaaggttccaggcctaggcctagggatacttagaacagagaaatgttctaggctaaggccaagcaaggtattcacatagcttgggcacatcacatgcctttatctgaggaaataaaatcaacgtttacagttattagtaaaatctataatgtttgtggctagtgtatcttttcagtacaacagacaagacccagcattattctaacaacgatgccttttagacttggatacactaatgaggtctatagaaaatagtctacctctgcatgttatgatgatgtgtgttcctgagggcatgacttcatcaggttaccatagagcatccagatttactcctgcagctgagagcggtagatttacccgaaattttaggatccctccatgtagcatatttttttcattaatctaaaagatgccaggccaaacagttcccacagttaatacctgctaatgcggcaaggcaaaagacatgtatggaattccccgaatctgaactttcaaaaaccacagtgtctcctttagacttgtatgggtttttgttgttgttgttgttggttttttttgtttttttgtttttgttttttgctttaacctggtgacctccatagatcctgcccttatcattagattattttattattttaataaaaaaattctagaaaaattacatgtaaagcaaatggtcaaacacaaaacagaggaaacaaacacagttgttaagtttattttattgagagtggaagagaatctacattaatgaaagccatggaaaacagaccaaaaccataaaataaagtgaatatggcagttagggtctgacattcgtggaactggggtggcttttgcagaatttaattacttgtgtttatttaatttgaatcttgtaaagcttgaacccttataccttcctcaacgttcttaagtctcatgcatgtgatttattcatttattggtttttaagagattgggtgtgacaacctcttcttgtgacagaaaatggctctggctccaagtgtctgggcacatgacttccagtagccatcgtcatccatctgcactgccgaatacctaaggcttcagcccagacagatagacacggccctgaaagtggccttaaccttgggaaaacacatgggcagaaaaatttcaatccttcaagggaaacccaaattattgtattatagggctgccatgtagcctgagtttccacaagcctggtatgttcagacttctgtttgttccacagacagtgactggagaaagccatctcgctatcatgactgcctgagaagtcagtaagagtgagccaggttctcaaccttcctaaagctgtgaccctttagtgctgttcctcatgttgtggtgacctccaactgtattttttcgctgctatttcaactgtaattgtactgcaaaaacactagctgcatggcaagttggcaaaactaactttgctacagttatgaatcaaaatgtaaaggtctgtgtgttttccaatggttttcagtgactcctgtgagagaatcatttgacaccccatcctttcctaccctaccacagcaaagacgtcatgacctacaggttaaggaccactgttttaaaagcaatacctccatcactctcaggaaggctgatgttagagcatctattatcagtgggattaggggacactgtcttgccctcctcttgtccatccttagctctctgctctgccaacattagctactcttctcatcgctggaacaaaagatttggcagaggcagtgtagaggagtagatgctgcccctaaacagggggatgcagtcattttctcagaaaaccatggcggcatgagtatgaagtcactggctacactgtatccacagtgagagagatgaatgttggtgttcaacttgtccctctccctctctctcttgtgtctcaaacagcacaggctggcttcagccccactgtgtcgccaggagtgcacataagctctacatccttctgcttctgcctccagagtgccggggctacagatgttagcccagctccctttccttgctattcagtgtggaccttagtccagatgttgtcattcatattcgggacatgtcttacctcttcagttaaacctttttggaaatacccttggagttacagccaaagtatgtttccagtgagattctaaagcctgtcaaggtgaaaatgaggattaatcaactcatccaaaggaagggaggcacagagaggcacttgaggagtcagctcaatgacatctcctagcagacagccccagcacagaggtcacagtccctcccaggatgatgttattcttttcttaagttaatattttagatgtagcctcagcaatgcaggaaactttcactccatatggactattagagtatttttcacttcttttttttctttcaaagcatctctgagcatttgaagatgagccttttaataaaatatcagagaacaatggcttgccatgaaactagtattttcatggtgcaaggaaaatctaaaacatacttctcaaataaatgtctggtcgttgggcatgaaacaaaggcaatgcattaaaattgtgcctggggatctacaaaaatgtccccttttgttcaggcaccctggtgatcacggtctctttctttattcgttatgaaactttcttaaagtgccacttctcttccctgtcttcagacttctctctagcatgctgtctttataattgtctctccttcacttctccttacactgcctcccttctttatttttctgggtttcacataactctaattcactaattctttgtctcttatacctcgtagtggtttgaataggaatacctccacagactcatgtgtttgaatgcttgacccacacgaagtgtgtgtccttgttggaatagatgtagccatgttgaatgaagtgaatctctgtggcagtgggctttgtcattcttctcctgtctgcctttgggtcaaggctttgaattctcagttcctccatcaccatgcctgcctagatgctgccatgcttctggtcttgatgatactggacttaacctctgaacatgtaagccagccccaattaactgctggcctttataagactagccttggtcatggtgtctctttacagcaataagaccctatctaaggcataccttaatgtggaattagattaaagttttaattttttgtgcaaattataatgtttatattcttttttatttcaattactaattgtgtgtgtctgtgtgctttatatatgtgtgggtacaggcacacatgtgccatggtatacatgtagagatcacaagataactttcaggcactgatcaccccttccacagtgagttatcgtgacagcactcaggtcaccaggcttgtccaacaggtgccttttactgtctgacccatattgccaatgtacatgttttattcttaatatttaagcccagtgaactgagaagtgtttgaggaaatatttaaaaagaactggcaagttcccatactacactgggcaccaaccgggtgttctcatctcagcaggttctctgactcagaactccaaaatctctctacccagcttgctatgttcccactggtgcgtggctaccacactagcctcaagctttaatacctccactgcctttgtggtgcacatcaggtaaacccacactttgtcgctcgcagagaaggaaaacaccacacaagcttagttcagaaacaatggtaactcagtcgctggatgcaacaactagaatcctaatcttgtaagccatattaaatctaattcctctggaggcggatcctggtggatctgctatgataccgggaaacactagcagctacatcttgccctttcgctatccccgttcagaaagcctctaactctctcctgctccctctcttcctgcccaactcagaagtcctgcctactcacccagttattggtctggtccctttatttattggggaagttcacaagaagtcacctgagtatatgactcattccagacagctgatcctgggagagcagaattaacataaaaatacaggcagcacaggggccatcacaacacagaagtatttttattttctctgtcctaattatacatcaattagttttagagtgctgaaaaactcacaagatgcagaaaagttttacagctgaaacacctttaatgtgaaaataaaacaaagttttaagatcagaagagattcactgcaaaggtccagagcgctcaggtggaaggcttagtcttctcatcactggctcacacagaataaactgtatcctgtcttggatcaccaacagaacggaaggaaatgcctctgtcctgcagcagactctctgcttctctgggggtgagcagctcaggtatgcacattccattgcaatcttccactccactgaaactaagggctgctgagcctgcattctgacttgaaacaactcggacacctgcaacaaagtaacccgaatgtctcagtggagacttttgaagtctccaattggagccttttgttgatcagcaaactctgggaagcctgtagataggcatttggtcttctcatacctgcaaagactaactcaagtgtttgcacatttccttgaagcaccccatagagtcctttgcttcatagttgagcaggagctaacataacgaaatccagtgttttcagaatgcctgtccacaagcagagtttagacagaatggacaggatgtgttgctgcaggcaggtccttttctggctgcaggcatatctccttctcagctctctccttctacttcatctccaggatggttcttcacccctcctccagtgcttgctcctttcctctcccagtcttctccctccatccattctatggccctctccatccttcacacttcctgttccctctggctaccccataaagccagggcaaccagctgctccaggagcttgccgcagtccccttccatatttgtagggagccagagacatggttgtggtgctgccctatggtagtatggacaccttaatcctactcctctctgctagtgctttttcggataagctgactgggcagtggtgcccatggttatccctcaggccatgaatcaccttcctgacacataagtagcaggtagcatgttgtttgggatgacgcccaagtgacagcaggggccaagttggaatgctggggcattgaatttactgacctcctccttcatctttgaagctccttttggcagaatcctgattctaaccttttcttcattctctcctggcctcctcgtgtctcgtcttccactgctgctgttagagtgtgcaaaatgttttagttgaacaataaggttgatggatggttgggaaggtactgggaattcataacaatggtctaaagccacctatacctgccgatgtgaagttttcaattttctgctttactggaatactggagtgagttgggtcctagcaaaatagccaacttactcattatttctcttctccaaatacaagctggtctccccttcaacaaacagatttccagtaacaaagacggtcccattccctgcccaacaaatacaactctcttgactgaacccagtgttctgagacacccattacaagcaattttaaatattcaaacattcagtttaggttttcccttgatttcccctctcagctgcctcctgttcctgtgccacttgacagctggttgtattttagaggcaggaggaacaggctggatgctgacagtgtccagggtgctcagaggtagggcctcacaagtgagaggcacacagacatgctgatgggaggagacccctgctttttaagtgttgctgcagtgtgcagtctagaagccaaaggccttgagatataagtgagatagttcccagagtaagtttgaccctagagcagtcgctctgagactgctaataaattctaataaatttattattctattatttatgagacttctaataagtctcaacagcaaacttagctatctttatcaggagtatctggcaggctaggaggagaagggattgggcaagtcctcagactggccttgcctgtttgtcttctgccctcggcttgctaaacttctcctttcctggcacaatggtctgcaaagccaacagacacccagactttcaccaagtacctttataacaggtggtttccttatttgtcccatttcaaatccagataaataaacagaagattacactgcatcctaaaagtccatctgatttctctctccttttgggttttttcatatatgaatgagaaatgtattcatccagcttgaagccctcaacagcccccaaacccccttctgtaactttaatattttcaaatcctagttctaatgatggttgttaaatgctttaacctcccttgtagcccactactcagcagaggtagtggaaaataaaggatataggggaagtggacctgtttaaaaatgtttttttggagcaaatcccatctgcattgtcagaaaatcagcagttcatttcattggtcagccacggcagctggatccattttcaaacacttcatggatatatcagcagttcaattcaattgtgtcagaatagcagcagatggcatttaactaacaggaatagctagggaggagggattcaaaccaacagaaatgtcaggcacagttctcagttgtgggtctcccgaagaagccatgattagtgaagacatgagaccaacaagcattgcccagctagctctacaggcaagccaagctaggtcctggcacttcattgaattctttttatactccctccaaacaccatgtgtcttcaccatgtgagtcttagcaaaactacacatgagactatctcagctgatatcactctgccaatcagcccgagtctgtggaagctgcaagaagctgcagcacactaccagaagtattttggtgcagtttctctctatggagtcccaacaaatggagctcaattatgcaatgtaaggcagaccaatatatgtgtgtcattcattagtgaagaatccttcatcatgtttcctttcacgtgcttggtttagcagaacatcctctatctctgtctgcttcagtgaaacgttcctttgcaagtctgccttagctttcaccgtgttcacttcagcaaagcattccttcacatttgccccagcaaaacaccatccaacacatctgactttgcaaaggacccttaagtttccacttcaccccccacccccagccagagcaggcactggtaggcaggaaaggctctgaacttgtttctaatttctctggtgctctgtgagtacactcatgcacaacttgattagtgaggagcttaggcctgatcccagaaggaggactcttttggatttagttcccttccacttccaggagggctctgtgtggaatggctgtgcctctccttgtgtagttttctggaacactcaaactcaaataaaaatctaatgtctacctcctccaccaccagttaaaaaaaaaatgtctgagaattggctattcagcaaaacagaagatggagtgcctttagtcaccttattcgtcttctggattgttgagcctctccaaccaagaacaatgtaagccaaagaggggagggtggaatataacctccccctaatgcaataaaccctgtgacttcatgtatcttcccaattctaagatcaaaacatttttatatttagctaaatatatggctgctatgaatgcagtcagcaaaaaagtcaccaaacttgttggaaaacaggatatttagtgaaagataactgaaaattcaaagaatgctggcatactgagacatggattttggaatgctctcactgagatcagcaattagagttggggaagctgaaatgcttacggcttgtattctcagatagataatcatctcttatgaaaaatatgtactcatccttgtacttaaactgaggaaccaaaacctatcaggaggaaatttttttttttatttaaacaacttttattagatattttcttcatttataattcaaatgcaatcccaaaagtcccttataccctccccccaccctgctctccaacccgccccctatctggccctggtattcccctgcatataatctttgcaagaccaagggcctctcctcccaatgatggacgattaggccatcttctgctacatatgcagctagagacacgagctcaggggttactacttagttcatatagctgttcttcctatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatgcagctagagtcaagagctccggggtactggttagttcagaatgttgttccacctatagggttgcagatccctttagctccttgggtgctttctctagctcctccattgggagccctgtgatccatccattaggtgactgtgagcatccacttctgtgtttgctaggccccagcatagtctcacaagagacagctatatcagggtcctttcagcaaattcttgctagtgtatgcaatggtgtcagcgtttggatgctgattatggggtggatccctggatatggcagtctctacatggtccatcctttcatctcagctgcaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatccgtgagtacatattgtgtgagttcctttgtgaatgtgatacctcactcaggatgatgccctccaggtccacccatttggctaggaatttcataaattcattctttttaatagctgagtagtacgccattgcgtagatgtaccacattttctgtatccattcctctgttgagggacatctgggttctttccagcttctggctattataaataaggctgctatgaacatagtggagcatgtgcccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgtttctctttctccacatccacgccagcatctgtgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattcattgttcagttctgagccccattttttaatggggttatttgattttctgaagtccaccttcttgagttctttatatatgttggatattagtcccctatctgatttaggataggtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggcttctcttcttttaggtttgttgagggattaccttcctgttttttctagggctttgttcccgttcttgtattggtttttttctgttattatcctttgaagggctggatttgtggagagataatgtgtgaatttggttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcctctatatgttacttgacctttttcccttactgcttttagtattctatctttatttagtgcatttgttgttctgattattatgtgtcgggaggaatttcttttctggtccagtctatttggagttctgtaggcttcttgtatgttcataggcatctctttctttagatttgggaagttttcttcaataattttgttgaagatgtttgctggtcctttgagttgaaaatcttcattctcattcactcctattatccgtaggtttggtcttctcattgtgtcctggatttcctggatattttgagttaggatctttttgcattttccattttctttgattgttgtgctgatgttccctatggaatcttctgcacctgagattctctcttccatctcttgtattctgttgctgatgctcaaatctatggttccagatttctttcgtagggtttctatctccagtgttgcctcactttgagttttctttattgtgttacttccctttttaggtctagtatggttttgttcatttccatcacctgtttgtatgttttttcctctttttctgtaaggacttctacctgtttgattgtgttttcctgtttttctctaaggacttgtaactctttagcagtgttctcctgtatttctttaagtgatttattaaagtccttcttgatgtcctctaccatcatcatgagatatgcttttaaatctaggtctaggttttcaggtgtgttggggtgtcctggactggacgaagtgggagtgctgggttctgatgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgtgccgaagaagaaggcccaaaacagggcctttctcagaagctgtgttgctttggcagttcccagaagctgtcagcttctgtggtgcagactctcatctgttcagactaatttcctaagttctgctgaatcctggaaccaagatggcgaccactgctgctgaggctgaggccgtctcccaagccaggcggacacctgtcctctggtctggacggtggccggctgtctgcggcccgccaagggtgctgcctcagcggctctgtgcttctgcctgtcccagaagctgtctggggaaatatttttaatgacagtttccacaggaggaaataaattacagtataagagagaagagagaaatgtcacagtgcaaataggtggaggatgaaaatcacatttccaacccagagagatggatagaacaatgattccagatgacattaagaattatcttgaaattttggggaactttttttaaaaaaataatccctttctgatactggagttttagggcaatcaggcaccaaccccaagcatcccaacagactaagcacagagcctatcccagtgcatcagttaaatagaagggttaggggaaaagtagatggtgaaatccacagagccacactgagacgagctccacctgctctcagtttcatcagagagagaattgggtcagaagttgaggcatgaataatgcagctagtgtgctacggctgataagtaatcagctccaggtcttgcaaagagatctggaaatatcctgcccctgttgatatgtaaaaggaataagttggttcccatgagatgctgagtcttctcacagggtgcacctactatcttgatagccatccccattagggactgctctgtcctgaaaggctccctgatgcttagtcccttatcaaaaagatgctcattagtagttctatctcctgggacccaaggtaacttgtctcttgcaggagacagtgacacaagaggaaaattagaaatacacagagggacaaagtagagttaggccagtgatcagtgctgtttttcttgattaaaaaccttaatgttttcaaaattattctaaacaacaacagcaacaaaaaaaaagtccactgctaaagctgccatcacaatacaggtatagtaattagggatatattcatagatggtgaacaagatgttcataatttcagtatttcatctgtgcatgaatggttacttagcctgtccacccacctctcagaaaaggcagtagtcatggagcaaggaagaagatttatttggtaagccagcaaagccaaacgatggtggtgggctgcataccgaaaaaccagcttaacatggtatgtttgatgctttggtgtgtttcatgcttttttccccatctgtaggaaggacgcagcttaggaaataactgatgtcttcctggtatctctgcagcagttcctctatccagcagatattacaaaacctagggggtgttagcattctatgagttttgcatacagttgtgaggccatcattctcttgcagatcttgaaagtcttaaaatcatcagtcttgaaggtgaggagataaattgaggagatttttggctcagtgctgttttgtgctcttttagacaaacactccttggatgattaataagagctgcctagaggtgttttctcataatagatcacagatatgcggttaaatacaacatggaggaggtggggccagattcctttgaactgtatgcccaactacaaaatgagcaatcatatgtatagtcatctaccagaatttcccagattccaagaccacatttccaatttgtatttgtttcttttggctaaagagcaaaacttagctatccaggtttggattgctcaccactttctaacagacatacccatacactctaggtccacacctttcctctccacaaaaataatctttgtgtgcatgtatactactataggtatttactccatttttctctctgatttaattagaacttctcttcttgttcatttaagccagatcttgctgggggttggtctggtactgtgcattcaaattctaattattagcccctgagatctagctacccccaatggacagatcctcacatacaccaagtgatactatgtaaatgttgctccctaatctaaagctatttattgtttaaataatggtgattatagccaattgttggggagaatagagatatgcagaacttgagttattgggctagaggttacaggcagaaggttgcaagaaggagaagaacgaagagagagggggtagcacagaggaggagaaaatgggaagaacaggatgtgtccgttagatatgatggaccagcaacacatgcccatgtctccccaccccaaattattgaaggagaaataacccagaaagattcaaacagccagtatgttgggttcacagctagggaaatacagccattacaaaagtatattaggggtaacaacccccccccccaagtagttaccaaagccaaataaagaaactatagcctgagtctcatttatgtgtaagctaaacaaagataagcattaaccagttattttacaaggtctttcatgaagaggacaccatttcaccagcaagaccatttgtgcttgatattccctgaagcacttcatctaaaactgaattcttacacccttttacatttcagttttagaaatgagaggaattttagactaagacccatagtttttaatcaaatattgaaagacagtgtctggggatagttcctgcctgagtccctgccctgactactctttaagatggactgcaacctgtaagatgatttaaacccattcctccacaaagctgggttttgctcaatgttttatcacagggggaaaaaaacaacaaatacttaaaatctgaatcatttcaagtgtcaatagattgaactatttctgggagttgacacaaacttcctcaggaaatcaattgtctcagcaaaactgtttcttagcgatggaaagtaaagtagaacttgcaaaatgctggagatcaaaccaagagtactgtgcatcctacgttagcactctaccatgcagctatgtccccagcccataatttcctcaattctgcaacccagtcatatgtatgtatccacattgaaaaacaaaagcagttatctttaaaatcagaaatactgagagctacaatatttgaccccctactagcctaaatacaatagtctaacctttggaggcctttttttcctagttaactgtaacatactgagggtcaggacactgcacatgaaaagagttctaccagaaaggcgtttcctggtacccttgagtttggattcacagattaaaatgtttgacttatttgagagtaatttgtttggagattggcacaccagtgctacagatagttcagttctttactagtcaactattatcagattcgacaattgtgggaaacatttaggtacaaagaacaggaccaggcatatgcaaaatccacacattggtagtaagaaaatagataattagaaatgggattataattttatagagcgtaagacaaaatcatgagaactaacaaacattactggggatgttcaccatgtatgcagttaaatctgaatgttccgaagaatgaaagctgttgaaaatgagatctaaccaatcttgcatctatttctctgctttaatagcataatacgtgtcttaattgccttttttggctgtgaagaggtaccatgaccaaggaaacttataaaagaaagcaggggagttgtttacagtttcagagggtgagcaaatgaccatcatggtgggaagcatagcagaaggcaatcagacacgaccctggagcagtagctgagagatttaatcttatccacaggctgtagcagagagaacaagtctgagcctgctgtgggcttttgaaacctcaaagcacacacccagtgatacacctcaaccaacaaggccacacccccaatcctactttttctttttttaatttacatttattttctttatttacatttcaaatgttatccccttttccagtttccctccctcctggaagcaccctatcccatcctccctccccctgcttctatgagggtagtccttcacccacccacccacccactcccacctccccaccctccattcccctacactagggcatctttcaagccttcatagaaccaaggacctctcctcccattgatgcatgacaaggccatcctctgctacatatgcagctggaaccatctgtactccttggttgatagcttagttcctgggagctctgggaggtctggttagttgatatttttgttcttcctatagggttgcaaactccttcaactctttcagtcctttctttaactactctattggggaccccacactctgtccaatggttggctgcaagcatccatctctgtatttgcaaggctctggcagggcctcttaggtgacagcaaatacctggtgaggatttggagaaagaggaatactcctccgttgctgatggaattgcaagctggtacaaccactctggaaatctgtttggtgattcctcagaaaattgaacatagtactacctgaggacccagctataccactcttgggcatatactcagaagatgccccaacatgtgataagaacacactccactatattcatagcagccttatttataatatccagaagctggaaagaacccagatgtccttcaacagaggaatggatacagaaaatgtggtacatttacacagtggaatattactcagctattgaaaacaatgcattcatgaaattcttaggcaaatggagggcactagtaaatatcatcctgagtaaggtaacccaatcacaaaataacacacatggtatagactcactaataagtggatattagccccaaagctccaaatacccaagatataattcatagaccacatgaagcccctaatccttcttaaatagtccaccaatccaccaactgagagccaaacactcaaatatatgactatgggagcattctctgacaaaccattgtgctacccatctttccatgtgttgcttatttcaaaccaaagtgttttaccaagaaatctgttgggctgaaagaccattaactaattatattcctttatctacatgatacgttgatttttttgctatttgttacctataaatggaaagcatgaatgctctgccctagagaatcaagaccagaaacaaaaaggattatgaagacctttaaactccaaaatgatatattgacttaaactcgtttatatgaccattattacagatggtattttatgctattttagaaatggcataaaataatggctcaatctccttttgctcttagtctggcaacattcctctctgctcggtgcctgctgtagccccttgcttctctgccttggttcccatttagtactaacttagtaccagttctattttttcagaacccataaacctcatctaacattagaatagccttacattcctaaattgacgtaggattctagccaaaaagaatttgccaaggcttgtaaagcccttgtgtgtcctgtgctcgggtaaaggtaaacaaaatcatttctagctaatttgtcttttgtaactggagacatagtgagcatgaatttcttctgaatttgcaaatggtcacgtttctgtctattgtagagagtatttacctgcctactgaagaatgtgttccccaaggcaaatatcacctggtttatagacggaagatttcttcaaggcaacgaagaaggtaaggcaacaaggccaccggaatgggtttggcattactaagggttagaaagcctcagttcccaggctgatcttggcatttgaaagtaattgttgttccaagaaaaacatcatcttacctactaggcgtcactttctgatacaccatcttgttcctccaagggggtagaaggcaacattttcagaataaaagaggtgtttcaaaataaaagttgatttcttcaaacaacacacactctatttattttgtgtcagtaaaagtaaatatcctgtgtgaggacagaaccattcaaataaacatatcattactaataatatctctgcctttgtagcatctctatttgctctgatgtttctttattgttttaatacatcatcttcaattttcttggcaccactgcaatcaagtgataataatttccagtttcttgcaaatatctggggtagcaccaaagggtgtggcagtagggatggatataagggaagtagtttactggaaaggcttatgtccctgagacagtttcccatagtatttctcataggtgctaaccattgcaacacaatatcaggcatcagtgcctggacaacaggcttcctgccgactcattcttttaagacaacgaacaactgagtcacaaagctcttgctcaattattcttttttaatttctaacattaacagcttctgttgctggatgattttattaatccccttgatgaattacttcctggttaaagagtttactgtaaaagcagttaactccaatgataacacaacacactcctgaaattgcgtgttaaagattacggtgagtgcgttttcctgttaagaaaacactgtataaagaaagcacccagagaggatatgcctattacttactccaataagaggccagagggtgtgatccgaattccaccannnnnnnnnnnnnnnnnnnnatggattttcgtatattaaaccatccctgcatccctggaataaaacctacttggtcaggatggatgattgctttgatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctatcttgtgaaaaagtttgtgcagaactggaattagatcttctttgaaggtctgatagaaatctgcactaaacccgtctggtcctgggctatttttggttgagagactatttataactgcttctatttctttaggggatatgggactgtttagaaggtcaacttgatcctgattccactttggtacctggtatctgtccagaaatttgtccatttcgtccaggttttccagttttgttgagtatagccttttgtagaaggatctgatggtgttttggatttcttcaggatctgttgttatgtctcccttttcagttctgattttgttaattaggattttgtctctgtgccctctagtgagtctacctaatggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttttctagagcttttagatgtgttgtcaagctggtagtatgtgctctctcccgtttcttcttggaggcactcagagctatgagtttccctcttagaaatgctttcattgtgtcccaaaggtttggttaagttgtggcttcattttcattaaactctaaaaagtctttaatttctttctttattccttccttgaccaaggtatcattgagaagagtgttgttcagtttccacgtgagtgttggctttttattatttttttttgttattgaagatcagccttagtgcatggtgatctgataggatacatgggacaatttcaatatttttgaatctgttgaggcctgttttgtgacctattatgtggtcagttttggagaaggttccatgaggtgctgagaagaaggtatatccttttgttttaggataaaatgttctgtagatatctgtcagatccatttgtttcatcacttctgttagtttcagtgtgtccctggttagtttctgtttccatgatctgtccattggtgaaagtggtgtgttgaagtctcccactattattgtgtgaggtgcaatgtgtgctttgagctttactaaagtttctttaannnnnnnnnnnnnnnnnnnntttgctaggccccagcatagtctcacaagagacagctatatcagggtcctttcagcaaattcttgctagtgtatgcaatggtgtcagcgtttggatgctgattatggggtggatccctggatatggcagtctctacatggtccatcctttcatctcagctgcaaactttgtctctgtaactccttccaagggtgttttgttcccacttctaaggaggggcatagtgtccacacttcagtcttcattttttcttgagtttcatgtgtttaggaaattgtatcttatatcttgggtatcctaggttttgggctaatatccacttatccgtgagtacatattgtgtgagttcctttgtgaatgtgatacctcactcaggatgatgccctccaggtccacccatttggctaggaatttcataaattcattctttttaatagctgagtagtacgccattgcgtagatgtaccacattttctgtatccattcctctgttgagggacatctgggttctttccagcttctggctattataaataaggctgctatgaacatagtggagcatgtgcccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgtttctctttctccacatccacgccagcatctgtgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattcattgttcagttctgagccccattttttaatggggttatttgattttctgaagtccaccttcttgagttctttatatatgagtggatattagtcccctatctgatttaggataggtaaagatcctttcccaatctgttgggnnnnnnnnnnnnnnnnnnnngaaccaactgagtcacaaagctccttgctcaattattcttttttaatttctaacattaacagcttctgttgctggatgattttattgatccccttgatgaattacttcctggttaaagagtttactgtaaaagcagttaactccaatgataacacaacacactcctgaaattgcgtgttaaagattacggtgagtgcgttttcctgttaagaaaacactgtataaagaaagcacccagagaggatatgcctattactttctccaataagaggccagagggtgtgatccgaattccaccagcatacaactgcatttagctaatagttttccaaatagttacttcaaaattagcagcaaaaaagtttacttcaaaagataagtcagaaggatttctttcatcctttcaaatagttcttaagccaatagtttttaggactactcacaaaggggagagagttattgctatgtctgtgactccaaatcacaaattagtgttagattcaatttgtgtgtgtataaagtttagagacatcaaatacaattattcataaccgttatattttctaggattttgtgactctgttttgtgaatggtcctgaaagataatgcattttccccattagaattaacgttctatgcaattttatatagtttgtagaaatataggaacacttgaatcatatttatagaggtcattcaaaatcttcaggttcaataccacagttcagtgagcgagagtcagaggggaagttaagtgatcggacaagttttatgagtctgttgagatatgttggcatttctgaagccagtcaccatagattttagaccaaaccttgttttagctcctcatgttcttgttgcatccacactaacttaatttctccattagtaaaaccagtgcctatggtcttcattcaataaatgtctcttcataattcaaaaaaaatattagcagcaaaaagccttccacatgagccaggcatgttggcaagggcctacaatcctagcatttgggaggtaggggacgggggtnnnnnnnnnnnnnnnnnnnnctgcctttgtagcatctctatttgctctgatgtttctttattgttttaatacatcatcttcaattttcttggcaccactgcaatcaagtgataataatttccagtttcttgcaaatatctggggtagcaccaaagggtgtggcagtagggatggatataagggaagtagtttactggaaaggcttatgtccctgagacagtttcccatagtatttctcataggtgctaaccattgcaacacaatatcaggcatcagtgcctggacaacaggcttcctgccgactcattcttttaagacaacgaacaactgagtcacaaagctcttgctcaattattcttttttaatttctaacattaacagcttctgttgctggatgattttattaatccccttgatgaattacttcctggttaaagagtttactgtaaaagcagttaactccaatgataacacaacacactcctgaaattgcgtgttaaagattacggtgagtgcgttttcctgttaagaaaacactgtataaagaaagcacccagagaggatatgcctattactttctccaataagaggccagagggtgtgatccgaattccaccagcatacaactgcatttagctaatagttttccaaatagttacttcaaaattaaaaagtctcaaaaaaaaaaaaaaaaaaagctttactgctttactgtaaagattctgggagggttcagaatgatctgtcctgtggggacagataatttttatagtaatttattgctacaatgcatgcaatttggaagttatcctaactgttattgttataagatactagagaaggctcatgggaccaaaactgaaaatgcttatcaatatacagcttatttcagaaaaagaatatgatctggtaccagagttagaatacacatcatccgttacccttgggagaggaggaggaggagagccaatccacacaaccgactgggcattcactctacaaggaccagacccacacatgctttctcaaactaggaagccaagatacacagaccagcatgaaagtgggaagctcagatccaggatgtgagcttttgcattgtattgatatatatttggtatattcttactatatgaccagaatctacaatagcgccctccaagaggtcaaaccaattcaagtacaaatcaccaatctcaccattactaaatgacactaatgagttggaacaatttttccccaagctcttggatccatagtcataagaaaagcatataatgaatgtatattgcagcctgattacgaatcaatgtgtattacagcctgattatggatcaatgccacttacgagctggaacaattggctcaggttaattccagctttgttggaagtgggcctagtttcccagaagcaaaaggctaactgcttgagagtctgcattactctaaattagatgtgtgttgcagcgtaagtctgtgggctctctactaggatggggtggcaggatggattaagccatgagttaaaggcaagtgtgggcaacaaagggaggtcctcatcctaaaacaaagtaaaagctaattttatttttcagtgtcttggcatcattgtctggctgatgcagaaaatgtcagtgactaatcatgtttcgtttgtcctttgcaggaatatacattacaaatgaagagaagaattgcagtagcggattttgggaactgaagtcagttttaacaaggatgcacagtggaccatcccaatcaaacaacatgacagcttggtgtatggctctgtctccaggccccagaaataaaatgtggaatacttcatcacaacccatcacggtttcctttggtgagttgcctgttgaataaagtcaataagggttagtcaagaaagccccaactcaaaacatgactatttggaaaggataggatttttgtgtttccacaccagtacaccaccaggaagctctccatataaccccaaattactaaatttcaaattattaaacaattcatatgtagaatctaaaaaaaattttttcttcaaataaaaaccagatgatcccttttcctgtacaattcctaacagttatttttttattattatcataattcatttttattttctttttgtttttttccagacaggcttttcagtttgttgcctacactagcctggaactcagtatctagcataagctggtctctaattcctgtcgatctgcttgctttgccttccaagtgttagaatgagagccatgaggccagagccagcctaatcatattgtttaaacaataagcattctgtttcatttatcatccaatgaaaattaataataacatgtgtgattaattgaaatgtaagctatcttaaaattcccaagccataaaaatatttaggactggtcaatgactcagggggtaaaggcacttgctgtcaagactgaccatgggatactatcctcagaccccacccacctggtggaagaacagaacagactctggaacatagtcttctgatcctcatgtgtgtgctatggcatatgcactcaggcacacacacataaacaaacaaacaaacaaataaataaaatgtaaacaatggaaatatttaaggaatcacagcatgcatactttcactgtttagatatgggcaatgcttgcatgccatgagaacttattacccaggtttgaagcacagtatctatctacatggagacttttatgactagaaaaattgatatattcagccactccagttattacaaaatttgaataaccaggagatttactaccccgagtcacataaaatacttgagactttattatataaaatatgacaaatgtctcagcaaatgctgtgacaacagctctgcctatttcagaatgcctttaatgctggccatcaaatgttcatatttaggagcacttggacaaaaccaaacggatttgtaaatcaatgttatagctctgtatctgttacctctttaactgtttaactgttgtaaactctttaactcttatcctatcttcataaatgttgtctataacataaccataaaaccatactaatttatacaggaaatcttttatacaggacagcttgcatagtgccctgacagagtccttacagaaacaatagatggttactggatctttagatgaaggacgcatctagacacaaatcctttcccagtactcacaagcaggctccattccaggatgagtcaaagccagtatccgctgtgactctggctgtgtgtatatatttaaacatgaaaaattaaaaaaaaaaccactgtgaattccaaggcactccttcagaaattatgatgggtttatatgaaaacagcttcacttgccttttcctagctctctaaagaattatcacaactctttcctagaagacaacacgtaagaagggctgcagtcttggaacaatatgaagtttaccatgtctcgtatagatttgccaagagctttggcagaatctgaagccatgacctaaaagactctaaaaccttcagttcctaaacacaatactattcccatgtgactcccccaaaccaatgtcttctgatattaaagccatgctttgtttcaatatcagaaaataatgaaaacttttaagggaaaatagaatactgattttcataccttaaactcaataattcatattttacatggaagcccttcttcttgtataggttgagactcagagccaagaggtaaattttcataaccacatgaacctttaacccttaaagtgagatagcaaagacaataaatcctggagtttgccaaaactatagctccctttatgatcccattcaaacgcaaatcactgtgaacgaatccaaagacacaatcagggctccggacagcaaaggcattcttgaatcgtgtttcattatgtgttccaggttcttaagcactgctggcagacatgctctctggggtagtcctacctgatgctttctgaactctggagtgcaccccctgatgcctgtcacataaattattgctttgccaagtgttgtcagttcctctgttattactatgataaaacgtcatgaccaaaagcatcttaggaaaggagagcttgggttttgagttttagatgggcagagaccatcagtggtggacaaggcatggcatgctggcaggaatgggaagctgactggtcacaccaaggctacacacggagagcagagggaatgagagggacatgagaagcacaaagcacagtgagtagagtgagatgaagtgaaccctcagcctctccccaaggtaatggactttttgatggctccaccttccaagagttctaggaccttaccctaatagcacccttcagtggggtaccaggcgttcacatatgtgagcccctgggggacatttctcattaaaaccacaagctcttattgctgacaagatactgaaatgaaaacagaagaaaacctaccctctcagggtcagaagagagaaattgagagacttttcaggaaaagaaaagaaactttgcggggaagtagtggaagttttctccttggtctaggaggttttgtcctttggtctacgacaaagatcataataccgaagactgagaggtactggtcctttgaggtgctcctcttccgggagcattcctagattgtgattgtgtgcttctttgagaaagaggagatgggtattttgtttgctgtcaatctaaaagttgattataaaatctctttggttttctaaatatcgttagctgtcattaaagttgataagggttcagtaccagttataacttttgaggtcaagccatttttgtgagacctgaaggttggcaattgaatagtgtgtgtgtgtgtgtgtgtgtgtgtgtgtgtgtgtgtgtgtgtgtgcctgtgtctgtactacatgtgttcttgatgcataattctgctcatgtattattttgggatatggagaaagccaaaaagatatcccaatagctgagtgaagagggacactgagctttaaagtggaagattctagacaaatacttcttgcctcatgaattcttacagtgaggcaagcttcatatttgtgactgctcccaggattcttaaaaacataaactgagaatttaatattcatacaaatcacccaggaagcttgctaaaatgtagattctaattcggtaagtctggagctgggttccacatttctaacaagaccctctcccacttgtctgtaggttacactttgggaagaaaggctccaacacgctgtaggatttagctcatttcttaggtagagcagataaggtgtggcaccctgatacttgatcacagatatgctcaaaactaactgactcagctcctcttgtgggccagactcctggctgctgctgtgcctgagtggtttctgagagctcccgagcctactgcagagtgacttcagacagtagagaattcagaaaggatggagttgcttataaccaaaagcccctccccacttccaacactacagcccatgcagtgatgggaaatgtgcatgagattactctgcagacgctacactcaagaggtgggaaaatcacttttccctgttaggctggaaccgtgtctttttaacagcactgacttttcttttgaccaaggcagtgtctctacttttcagtccagtttgagaccagacagacactatctgagttggatttcttgttgaaatctatgtgggatctagtcgtggggcaaagagctcttctccatatgcaataaaaatcagtatgtaataaaaatctccaaaatgaactaagaggctaactctctcagcttccaaagatatttgtgtattatatttagaagaactctgttctaaacaaaggtgtccgtcagtgaaataggaatgccttccactgtagaaatctgggcttgaacataagcaatacctttaattctagaaattagctcttcatctgtaatgggtgagagagtaaattatttactttttatcaataatgttatctttatcataattatcaactaagaactagagcacagaggctgtaatagacagtatgtaagcaaagtaatgtgactatatccaaaaatacgttatcataagcatagtgcatcagtgggatttgagtgtaagcattggctttcaggctctgtagaagctttctatagagtaaaccatgtcggcatttcctttgcagctccatgcttcatcttctcagcttactgtattagaagactatgattattatctaagagcaatcagacatgtaaggttgctctttctgccacttttgtatgcactacattatttccatttatcagtatctgcaaatacagtgaggaacaaacccattgcttcacaggaggaggatgacccatgaaacatagtggcaagattgttgctagcactaacattaagggaaaggaacatattacaagggtcccctagaacgccacaattttaaaacaggtttatataaggaaacttgaaattgagaaaatgtcaggaaacagcacagtgaccaagaagtcttcatgagtctactgtgcatggactgaaacctctgccttttggatagaatgtgcagtgcatgagagataaaaacatgctaatcaacaccaagacagaaagttgggagtgtgacatggcaccaaactgtgatgtcatttgaagaggtcagaagaattctagatgtggagcaagaatactaccatcattttgttaatctaatgattttcctaagcagcaacgttgtgtctagaaaagtcatgaaaatcatccaggatcaaaaattaaccagctacattttaatctatattttcctaaagtcaataaatcccctttgtacttgtaattgctttttaaaaaaatccttcaggggcaggagagatggttgggtggttgggatatcctgttcttccagaggatctagatttgattcccagcacccacactgtggcctgcagctatctccacttacattacacttactccgctacagttccacttccaggagaccctatgccccatctggtttctgggggctgcctggtgcacatggtatacaaacatgaatgcaggcaaaaaaaaaaaacccatatacatataataaaatgatttttaaaatttttcttcagtaggactatttataaagcacactaatggtggtggaaagaaatagaatgaatgtaaaatataaataaaacaatacatcttagcttcaattttacatgcacacatgcaaacataccaatgtgataaacattttaatacctttcccactcaccagtagatctcactgcctactgtagagcaagccctcaatactggtttgccagatagtgaaaaattaaaatatttgagagtggcgtaagtattttttaaaacaatattttattcattgtaaatatctgccttacactttcagattcggtgatagccccaacgaaacatctacccactgtgacaggttctaccctgggtacacaacctttttcagatgctggagtatctcctacaggtaagaatgttttcagactacctttaatttacataacctattaatcctttaattaatcaggtggttagaactagcagatttgtatcatttatgcccttctttgctatagtatttgaaataaaataattgtccttatagttttcgagagttaacacttgaaactgggaaaattgatgtcaggaaatattcagtgaggaatttaaattctgtattcattattaaatagttaatacgttgacagccctcctcagccatattctcactgtggagtcaaataaaataaaatataatatttcaagtcggaatagtgtgagcctaggacagttagagcattttatgttaaatttgtctgacctcaaattaattcaccaagacagctagtgagtgctgtagacttcagccttcccatccacagcagttaacagctggagctgttggtcactgttgctatggtaaagtcataagtggcaggtaacctcagaggtaggcactgaggcaaacaaatcataatctccatgtccgtgtctgttgtacgtcacagatatccatggtgaccttctccgatttaaaaaactaaagtatatgtagaacagacgtatgattctcatttcatacttaatgaaaactatcacttttgtctagaaatgagggctgaaatggaataaaataaaagcaggccactggagtgaacaatggctttagctggtagcatttttgcattttgcctacagtcattgtcacatacagctaccttgcagaaagtgagaagcgggtggcaggtgagaaacgcctcacccatcagaagtttcacactcagcggactttttcttgttcttagtctttcaaaatgcggttcctcctctcctttctccctggcctcaccctcctccttcatttttgtagctaccattttcaatggccattgtttcaccaataaactacaacagactgaggcatgttcactcagcaaacatcagaagattcagtaatagtataataataataataataataataataataataaatatcttaagcctctgctgtatcctatgtatattcttagattgccatgtaaaaaattactctgagacttaataaattataaaatatctcaaatggtttcaggagccaggaatccaggaacagcttaggaattttagtgtggtgagtcattgccctgagcttctttcatctgaaagtttggatggggcaaaaccatgtacatcaaacagggttcaaagcaggcctccccaggctcgctgcatgggcctctcactaggactgcttccaatatagcggcttgcttccccttgacaaaacgcttcaagagatgaggctacaaaaacgtacctttttaatgtcatagtctccctgcatgtgattgcatgtcacctttgtctcattcattttattagaaacatgtctgttctcagggaagaaggctgaggctccatctgttgaagggaagaatagggattatggacaaatataagtcactatactgtatcacttggaaattttttatagtaaatgaagtgttgtttgcccttcattacatatatgcatagtggaaaaagcaaataccctttttgtttgtccagacaatacaccaagacactgagagtaaacatgatcaacacctagtgataacagaggctgtatttatgccagtctgctgactccgaatctagttcctactgcactcaatagcacttttccccaacaaccataaatgctcaaagaggtagagcatacttgttttgtcttctcacacatacgtaggtagtatgtataggtgaataactcaataaacaaacaaattgatagactattgaacttttgacatgtcatttaatacctgtaaggctataggtatataatagtatacataataatcttatggtgttaaaaatagcattttttattcagtcttcagaaaatttgaagcctacaggaaagagatgacatggacataggaccataataattcaaagcatgaaagcaaaagggccataccctatggaatagaaatgtccagatatgtcaggaagtgccatgctttgagtaatcaatggcccctatgggttcagatgatcaaaaaagatttcttaagggagaagatactagacacacacacacacacacacacagagagagagagagagagagagagagagagagagagagagagagagatcttatgtgtaccatatttatttgactagatgaagaccttgaaatttttcttagagaaaaatgacatgagcagttatgtttgtgatcacttgagaaagtgtcagtagacaagcttggtcaaggagatgacatcatacatcagaaaagcaaggaaggagactggaaagtgaagactaaagaaaggattgagtccaacttaatcactctaataagagtttaggagtgaaattctaatgcaactggatggatctggaggatatcatcctgagtgaggtaacccaatcacaaaagaacacacatgatatgcactcattgatacgtgaatattggcccagaaacttagaatacccaagatacaatgtgcaaaacacatgaaactcaagaaaaaggaagaccaaagtgtggatgcttcactccttaaaatggggaacaaaatacctatggaaggagttacagagacaaagttcagagatgagacagaaggaaggaccatccagagactgccccacccagggatctagcccatatacaaccaccaaaccaagacactattgcatatgccggaaagattttgctgacaggaccttgatatagctctctcttgtgaggctatgccagtgcctggcaaatacagaagtggatgctcacagtcatcacagggcccctaatgaaggagctagagaaagtacccaaggagctaaaggggtctgcaaccctataagaggaacaacaatatgaactaaccagtacccccccccccagagctgtgtctctaattgcatatgtagcagagtatggcctagttgaccatcaataagaggagagacccttggttttgcgaagaccatatgccccagtacagggggatgccagggccaggaagcaggagtggtgggttgggtagcagggcggagagagggtataggggatttggtggatggcatttgaaatgtaaatgaagaaaatatctaatttaaaaaaagagtttaggaaatgagaccggtcttcttgtaaacagctttttttttttttaaagaagaatgtgattgtactttaatttaaagtgtattttaaaagtaaagtaactgtgcaccagtcattattagcaccaagtgttcttctagacactgggaaagcagcaataaaccaaatagaaaagtaccctcttggcacaatctgacaaggattccttctagttgaattatttgtggagttaaccaacatgtcaagtgtcatgtttgctccaacactactcttatgtctgtgaagaaatataaaacagaaaaagtacagcttccaatttaatagagacgtttagaagttacagtaaacttatttgcatcaagtgtgctgggatgtgtgtgtgtgtgagtgagtgtgtgtgtgtgtatgtgtgtgtgtgtgtgtgtgtgtgtgtgtgtgtgtgtgtgtggtggtatgtgtgtgtgtagttgagaagtctctggagaagtaagccctcccttaaataaagcaccacttcacgggcctgagaacatccttaaatcagagtttaagaactgcccttccccaccctgagggagtatctgatagtgtccagcgagatttggtgttggcccagtaaggtgggaaggtgtcacgagcatcctgtgagcagaggtgagtgcttctctttactgttgtgtaacacagggtggcacagttctcatcacaaagcagtgtttgctcaaaatgttaacaaagcccagtctgaatcagtctcaggcataattagaacagatggatatcttttgctttacaaaatccgattgagagctcatcaaggtggacactacagattatgtttgaaacaattttctgcctaattgttatatgccaaagggatcatgttaaatcaatagctatcaaagaactcctaaattaaacttctctgcttggcccaattattagattactatggagaaacccccatttaatcttagcaccagagagggtcattgtaaaagactcatgattgccgagtcagaatctcataggaggcacctttgaaggtcttttcaagaaaggaattcagacagagcatgacacagaaatcaacttcagaaggcgatggttcactctaaactctaagatgtaaggagctatgaagttcaatcagcattacaaagcttcaattctgcccgcaagtgtacatggctcactcttgtattcaacaaaaggcaatttttaaaacaaatgtaggaggtcaaagatgcaatactctttacttccagaagaacattgtttctcaaataaaccgcaagaatcacccagggaagcctccttcaactccacagtagccagttaatgctgctgactccctaatgcagtctctggggcaatcactcgagacatattcattctacaaaacaatacagagtgccttcaatattggggaatttttaaggtgccatattatagtgatataggaattggacagtgctgctattgtacagagcttataattataagtaataagcctcagtctttccttgattcccatctactctgcccactaggccatagacgctctggctctgccttcttgtctttatgtctacatcagaacctttgatccaatgacattgattttgatgttacatccccattaataacttgtctggtcttcacagtcttgtttcctcctctgaacactttgagtaaaataccaggtctgctctgactccagcccttggcctgttcatcttctggcaacagctaatctttagaaagtggatgatcatgtgtaggaggcaaagagcaaagaaataagtactccaggagtgcaacaaagctggagacttacaaataaacatgtcgtaaatggatggagaacaaacaaaggagacacattaatggataatatcagaaggaagcaccataaagaagcatcagcaggtcaggacactgggtcctaaagcaccacagtcccagacagaattgaaaggtgatagagcacgttggtgatttgtatgtgataggaattccattagtttctgtcatcatcatatatacatagatataggaaagggataaggtagagagggcttgggtgtgccttagaggtagaatgcttgatggatatatggactgcatccctccaacaccattaataccaccacccctaacgccaaggacagcaatactcagagtaccatgctaagtatgcaagtggagttgaggaagcctcaacacagagtctggaggaaaggatgggctcaatgaaaaggacaatgcaaaatagatcttcaaattatcatccttttaaaaagttgcttaactttattattgaagagtttgttatttatttaaaaactacacattgaaattaaccaggtccaatgacttcaattgtcatcttaagcgcagatgtaaataaatgtaacacatagaggaaaagagaagcaggagatacggactgtggatttagactgctggatgccagctgttactgtggcctcttagtgtgtgagggaaacaaagaagaagatatgtgggtagtgaatggtagctgcaagaacagcatgccaaagacttacttggtgatgctgatttaaagtgacctaaattgatgacagtcgtagccaggcatttgtagagatggagactcccatgacaaaagacgcactgggaatgtctgaataaatatagggataagtaaaggattttagacaactgtcacacaaacgcctcgcaggtttctcctagcaagtatctaacaatcttccccattgccatggctgtgtcagatagctgaacagtggcactgatattggttgagttcttccaatgtgtgggattcttctaaactataaatgcattgcttcatttcaccctctcagtagcacaaacttgaaatactagtgctcccaatttacaggaaagaatggtgagacaaaaagaggttaaatagcaaaagcaacaacatcgagaagggtgtagagccaaaacagagcctaaacagtcagattttgagtcctactgcctctgtcagttcagatgttggctcaatatcttttacggtgcataagcccatgctcatttgaagttgctattgctgctgtggaagaaggtgacaaaaaaacctccattcatctttctcttctgcagacccatggttcctgagaaatttattctcaggtttggaaacttatgtttcctttgttggtaacatgtcagattgaagagctctcttccattctttgcctcttcctacaacaatctcaatataatccttgttgtaggcatgactctataacatccatactgaaaggaaggagggaaggaaggaaggaaggaaggaagggagggagggaggnnnnnnnnnnnnnnnnnnnnnnnnnggaggaaggaaaggaaagaaggaaggaatgaatcaatgctctcttttaatcttttaattctggaaatttatggaccaacaaggtgtctcagagggcaggataagttttggaagttgattctcttcttttactctaggtcccagatattgaactcaggtcaatatctggactgcatagtgggcacttttacctgctgaaccatcctgccagccccaggcaaccaacttttatgattattaacacttatcatttcatgtctacaactatacaacatatatgagcagttctgccttaactgtagtcttcgttcagttggtcttaaaccattttcagaccactaatgtagtggtatatgatccccttaccctttatttagcacctgttaggcaagccaccttccttgtgactaggcttgtgatgattttaggatatctccctccatatgtttctttttcacattgtttgaacatcagttaacacctcatgcagtccactgggatgggtaaggcccatttgcatgtgtttctatggccggatactcttaagtacaggcctaccatctgcctactgcatttgatggctctgtgctgcaggggagctgatggagagttattccttttttcacaagaaataaagcagaatgcttcaagttcatccagtggatgctctagtgatgaagtagaaggccaaaggaaaacactgtaatataaaaaataatttaattttcagccaatatcacaggagtataaggaaagtcttggataagtgagcttgacaaaccacattgttctgactgaacttgcaaatcacttttattcttgttcttggttgattacataagctggactgggtagcaaaaaataaattattttctccatcattttctgttcaaatgagatctgttgagtagtttcttgtcctctggaagaaatttcagacaagttacttggctttgggggcaggtttttatataataaatgtcgtctggtccttttcagacactagaacagacagacgtgtgtcaataatttaaaagtctagtcaaatgtagtgtcaaaacttgagaaagttaaattagtccagaatttctcttctctccataacccaagctgggtctgcctcagctgcaagggtaggtatatactggctttgtgctttatgtctgcgtgaggcaaagtcgaggaaacatctctgtcatgccttggtctgccttcagtatccccccccagcccccaacctttgttcctggtctaggtctctccttagggaaacatgagttagggaaaagagaggaggaacaagtaataaggggtttcctttcacaggatagctctattctgattcacgaaactcaggatataaagagtgacatgctcattgtcacctcatggacacttaggcaggaggtgtatttcagaatttccaaacattactaaaccatggagcttctgacatactagccatcttccctttctccagcaggcaggtggtcagtccataggaagatgggcaaggaagtaggctaaaaagcagttgaaaaaatgccaaataacaccaacattaacttttaaagaacatgcttcggtttcttctattcaatccaggccacaggaatagtcgacagaaactatgaaagagtaattgttcctttttagtgagatgtgtttaaagagttaaaacaaaatggactggaagactaaacctcatctaacctcatagaaggttctaaactggtataaacaaaacaaattggatgaagtagttgcttgttttgttttgttctgtttttttcctggaaacaacactcaggatgatgtatgtctgaacacttgcaaaatttaataacagtgagtcttcacattaaaggaaaaataaacagccaggaaacataacaatcatttgggttgcaatattttttgcccatagggtgtgtcataacataaaatcaatcattgaaaatccagaggtttgcacagaggcagtcttagccttgaactagaacaaaccaaagtaaagtgtcccatttgcatgttgagaagtaggactaatgtgaatgtttcaagaaatgaaaacaaaattccttttgggctgatattgagatgtaaagtaaataaataaataattctctgcttaccaagagacagtcagacatgattgatttttaaaactataacatttttaaattgtgataatgtaatacatacatacatacatacatacatacatgaattttaatcatattcatatttcactcttctccctagctcccccaagaactcctcacccccaaaccttccaaactcctctgtgtcctcgttttcatttgtttgtttgtttgtagtttgtttctttgtttgtttaattatccaagtgattccagtttgtgtactcataggtgtctggccatccattgaaacctggccagtctctcaagggccacacctttaaagaaaaccaactttccattctcaataagccatcaattgtcaatctcagctagaagtgaaggcctatgagccttttcctccctccatgcacagatgttgagtcccttggtcctgtgcagccaaccacagccactgtaagtttatgaatgcagtagtctgataagaccatctcttacagttacaaaatatccaggtcaggttttaggacgaagtgactttacaaaccaactcaagctcaaggccttgaggaagagacagtgttgatatcaccagtagcctgggtatgagctgtgctctcctgttgctgttgacattggggttatgccttgtgatggtctctggaccatctgctactcacacaggaaagtcaaagcactcctgaggaataggaagcatccagcctggtacaggcagatacacaagcttactaagtcactcaggcagggggagtttccacctgtccttccctggtccaattatcccatgacatttctggtctgagaacataggtttatgtgttgtcatatttggattcctcagttaattatcgaactcattcacgtctgctccaattattcatgtctcctccatgtgtgtaggctgcagatgagtaattgtccaaatttcaatttcagtgccagaaggacaggagctctcaaataattgctgagcagagcgcttgcagtgggtttgactgtaaatgttaagatgtagtcctaggatggggacagatcttattcctgagccctggtgtaaactggcaggaaggagaataagttgaagttatttagaaatctgttattttcccaaacagattcaactctacttccatgtgattaataatggcttctagtaaatgattcattctttcaataatgtgtgcaaaactttacaggccaagattgaaaacaaaagtccagtggaagaccaataaaattgaaaccaccttgtgtgctctggagacaggggccagatttcaccgtctcttttgttttctggagctcctgggttctaagtccttaacaaatgtcatagttttgcccgtccacagatgtttgagtggctgggattctaatgagctcagaaacattagcttaagtcagtacacatgacgaccagaggttctccccaaccctaggtcttccctttctgatgttgctgcctagtcaagtttccaagcagcataaaccatctcctaagtgatcccctatagttgacagtttgtatgcaatgacacatgatatctcgtctctttggacttcactagcaggtagcattgcagaaatgcttcctgtggctacctctgcatgtgaaccacttgtagatttacaaatcatgcatcatttatttactgtacacacttttccaaaagtttcattatttgtgttctctaaatggaacttttctaggacttaagagatggctcaatggctaaaagtttttttctaaagaaaattgaggcaggggctggagaagtaactcagtggttaagagcattggctgctcttccagagatcctgagtttaattcccagcaatgacggctcacaaccatctgtagtgggatatgatgcccttttccggtgtgtctgaagacagccacagtgtactcatatatatgtgtgtgtgtatgtgtgtgtgtgtgtataatatattatgtatacataatacataatatatatatatacatatatatatatatatacacacacatataaaattgaagcacttgggaagctgggacactgttctctactctcaagagcatgaggaaacacttctatgatgttggaaggacattgtacaattcacacagcattcatcttataaaacttggaaactctctcttgtcaattatgataaaaaatttataaaattgacttagtttatcttacagtacacatcagccaaataaaatacattgtttattttctaacatttgtcctataaaattcagggcagatgtgggactctatctgctaagagaacaaaatattaagtaattcatgttgtgccctttccctattctggtttcaatagaactcaactccttttatccatatttcccctgttattcgctgttttatttcttttgctgcatatttatgccaccttaggtacatttgggaacaaaggagaaatatatacaacaaaaatatattaaaagttcgtctctcaaggagatgcagacatggttgtggttgggtattttcctccatctgtctagcctcctctctagagaaacattcactttttaagggactatgaagcacactttcttttgtggtagggaagacaaaaatgaagagaaagggtatggtgtaaagatggagatgactttgtaagctaagaatgtaaataagtatgaaaccatagttggtatatgaaaatacattcctttgaaaatccatattaagccaagaattgaaataaatatgaaaccacagttattatgtataaatgttttattattgtgaacgttcactgtaaggtaaattttatgaagacagaaaccttgatttcacttattgttgctccctttggacctataatagtgtttgatacaaagtagatactgaatcaatgtatatttcaaagattgaatataacagatctgaatgtatcagaactgtgttagtagcagaggaatgatgagaatatttgttatgtaatcataagcatatatacttgtgtgctgtttttctttccatatgtaaaatgaggtcattagactatgtgtctacttggattccttcaaaggtcgatcttgttaaatttagtgtcttcattaaatatgtggcaataaatacagcaacctcaatttttgttttaaaaatagggtatctagctacaccttcagtgacaattgtagatgaaaatgggttgacaccagatgcaactcctcaaagtgagtatagtaaatccttctatgtatcatttccaacaaactcatacatcttactatgatatctaaaatattaaggtttgtgaataggctgtttttcattctttgctattattttgactgagttttcctgcaatgaccatgtatggataagatgatcattgttgccttcgtagtagaagttgatagcatgtattatactatacttttcgtttgtcaagggattttaacgtaatataagtaaccgagttacagggatagaaaaaggaaacacatcagtaccaagttggcattaaacataaaacacagagcatcaacctcaggatcactaggtctgagcaaagaaggacgtttcccacatctccaaagtcacacatcaaaaacagtacatcaaagcaaagctaaattacagccttataagaaaaaaaggtggattctaaaattaattttgtctttcagccagcaattccagcatgactactaaagatggcaactatttggaagcctccagtgggacagatgccaagaactgttgagtattgtcatgggtcctccattcattcacccagcacatgtattgagcagccactatgccctgtgttcataaccatattgtcgaacatttaaaaagcatcgaccatgtttaaagtactgtagcagatgattagaatacatacatgtacatagcagatctaagttccaaattctttgtgaggagagacaaatacatggtaactgatgatataaagaaaaaaactcaatacacagacatagggagagtcacagatgggcatcaggggctgccatggcagggaagacccacattctcaatacttctagagtaagatactattgtcctctctccataagtttaaaagaagaaaaaaaaaatcccctgcagtggattgctcaatttataatcattcacaaaaatccattagaatccaaaaaactgaaattgactgctcactcctcaactcttttgaaacccatcgctgccagttgaatcgggctgtaacgtgacaggcaatattggatgatgcatttggcaaggttcaggacaggcaatggtaatggaattttttctcttcccaatatgcttatttcaatagatttatgaagtactcacagcaagaaaaggaatgataatgaatagatttctgtgtccctaggtcctttgctgcttgggaacatgctcttagatttactgtatgaacctcatacatatttaaatgctgctacccctctgattgcattgcatttatctgcattcataagaatgtgtttaatgacattttgctgtcattttgtttactaacttaaagaaatctaagctggggtttaaaatttttagaccctaatcctgctttacttcagcccccagatttcctggtatctagcgatgaaatgtctattttactttaagtgcctatgaaatgggaatactctggcgggccaccttcgtagcaccatgggtgaggttaaacgagtcttggaacacattttcaccttaatgctcaggtgatcaggccatggagtggaaaattgaatcttaattgcattcttcctgatttcccttgacatccacctggtccagtgaagcttaaagctacattgaaaccagtccacctgaggcagactagcaaaaaaagccattgtaggtttccatcccctgaagtctctgactcaccacagtaccaaagtcagcaagttcatactcaacagcaaacatactcacatacacactggcacacatgtgtacacacacacacacacacatcacacataggggtgtacacacacatacacacatgcagatgcacacatacatatacacacagagacatatgtgcacatacttatgtgtatgcacatagacacttgcgcgcacacacatgtatatgcacacagagacatatgtacatgcatacacagagacatgtatgtacatatatagatacatatacattttcatgtcctgggactcagacttgccactactgattttaagagaagattttattgcagtttgtttggtttgggtttttttgttgtttattttattttattttattttattttattttattttattttattttgaggcacagtctttatcgggctcacacccagagtccactcatcttgaggacctctgtaaacttctgattttcatctccatgttcctctcttcctgcttctgtagcctcaagagctgctgcttcttctaaaagtggatcttggccttttcctttcacttctcctccagaatggcactcactgcctggtacctccactggaccccaagaaccagactccccaggtaagcaaactttctcatagtcgtcagtcacacagccttgaaagcagctgaatccatggttcttcttttcttgtcttaagactgagggatcccatccaacactttaaggtagtccagggcagcctatcctcacttggccttgtgggataacatgtctcacacagtgtgctgaaaaacggggctggcaggttcccagagaggagtcagtgtgtttgctttcagagaaagacaaggtactttaactggtttctgtagaaatttccagaaatgttgataccctcacagcatatagctaccagtttccagcccagcagtacttccttgaccaccaggctgtctagaagatggccacagctatccatcactggaacctgcccctccatcatctttgcgtgattgggggtgggggggggcggggattttgtgtccttaggttataaattacttaactttcaaatgttatgttgttttcttcagtttttgttttgttttgtttttactttctcttttttttttaatttaattttatttgcaattcactttttacattccatattccatttctcacggttccccatccaccctctgaccgctccacattccacacctcctccccatcccatcccatctccacatgaatgcccctaccacccacccgacctgacctctaaacttcctggggcctccagtctcttgagggttaggagcatcatctctgaataaacacagacctggaagtcctctactgtatgtgtgttgggggcctcatatcaattggtatatgctgtctgtttggtggtccagtgtttgaaagatctcacacttacagcaagttgatctttgaaaaagacaccaaaaatatgcaatggaaaaaagaaagcatcttcaataaacgatgctgatctaattggctgtctgtatgtagaagaatgaaaatagacccttatttgtcaccttgtacaaagctcaagtccaagtggatcaaggacttcaacataaaaccagatacagtgaatctaatagaagagaaagtaggaaagagccttgaactctttggcacagggggagtttcctaaccagaactccaatggctcatgctctaagataaagaattgataaatgggacttcatgaaactggaacgcttccgacaggaaaggacatagttgacaagacaaattggcaacctactgattgggaaaaagatcttcactaaccccatgtcagatagagggctaatatccaaaatatatatagaactcaagaagttaatcaccaaaacaccaaacaacccaataaaaaaatggagtatcgaactaaactgagaattcacaactgaggaatctccaatggctggaaaacacctaaagaaatgctttcttcagttttacaaatgtgtttcttactctgcccctagtcctggcttgactttttcagattcttggtattactaaatgtagcctccccttcccagcgtgaaacctgtttgttcaggtttcactgtttgaatcggagtggagcttgccactcaatcgttctgccatgcccactgctagagcctaccgctttgctattccggagccatacacgtggtcaccctgcaactggacccccaggattatttggcgggaatcgggccccttcccttccttcataactgagtgtcggaatagtaaaattgagctttgatcagaatcctgtttgacttagctccgttctttcttccatccgtctagttcctttctttcagctcgaactgccatctcagtcacaccgttccttgcaagccgctggccggcccgcaacaactaaagcttaaggattgtacagcagtccttctacgtttctcgggcagaggaagatgaggagactagagttgaggcgcgtttataatcgcagcactcaggaagataaggcaacagggtcccgaaggaggatcaagagtcccagactctcctgtgctacatagtgaaagcctctttcagaaatgaaggggaagaggcattcagtgaggagctgagagtcagtggtagcaggatcaagtcacatcagaacctcgagcagtgatgcaatgacacttacagtctctcaggtccttgttagttcagctctctaaactcagcattcctgtcctccacttccgaagtctcactattggctcatagcctgttccactgtctctcctctaaagcttggtctacttcccatcactccactgcttcctctgaagtcaatctcaagagaaaatgttaattctccaatttaaaattctactttcgattagaatgtcatttcctctagccacaaagactatgggtagtatcttatttttatggttgggtaccttgtgagggtcccatctgtgaactggctcaccatgcaaaaaccagacccagtagttaccaccactgtgtaggagtgaccccctaaatgtacatattcttcttgattggaaaaacaaggcaaaagacagaacatccaaattcctgcatatgttctatggatattctatgccacctcagccattgttctggacaaaagtcaaggacttacgaatactcccttgtggaagatttgacagcagagaaacagctcattaaacatctacttcctgagccccccatggtgggatacctgcctacaatcttagcacttggaaagtacaaataggaagatcaggagttcaaggtcatcctaaactacatagcaaattcaaggccaacaacatgggattcgtgaaactctgtctcaacagtaaaaatgggaaagctatttgtgtgtagaaaatatgatataaaaatgatcccacatactgggttgacatcaacaacccttttaagactaacagaaattatatgtggtttcatcaaaagaactgcaaacattggaacaaagtataatggcacatatgtatacaaaagcttatatgccaactttaaaaagtaatttaaaatttttaaaagctatttttaaaagaactgcaagaactcagaaaataatggacataggtataactcagagtggatttaaccacaattggaaacagttgctaatgtgtcataatttcctaagcaactatcaacaggacttaagtgaaaagttatgaactttagtaaaagttatgaacctaatgaagtaggatgcactgaaattgattaagcccttactgtagatgagaaatacccttgcctgagcaacagactttaccaggagctactcaagaaaggatataagaacttacacaagatgctgcaacatgatatcactatgttcatagttgtggctaatactagttttgtacaaaagaatgttattaattaccctggtatttgttattcctgcacaaaagccatgcttgttaaggatttcaatgacaacagtgagtacatatcatgtgggttctttcgtgtttgggttacctcacttagaatgatatcttccagatcatccatttgtctaagaatttcataaattcattgttttgaatagctgagtagtactccaatgtgttaatgtaccacattttctgtatccattcctctgttgagggacatctgggttctttacatcttcttgctattataaataaggctggtatgaacatagtggagtatatgttcttattacatgttggatcatcttcagggtacatgcctaggaatggtattgctggatcttctggtagtactatgtctaagtttctgaggaactgaaaaactgatttccagagtggttgtaccagcttgcaattctaccagcaatggaggaatgttctttttttctccatatccttgccagcatctgctgtcacctgagtttttgatcttatccattctgactggagtgaggtagaatctcagcattgttttgatttgcattgccctcgtgattaaggatgttgaacatttttttaggtgcttctcagctattcggtattcctcagttgagaattctttgtttagctctgtagcctactttttaatagggttatttgggtttttttggagtccaacttcttgagttctgcctgatatagttgtctcctgagaggctctgccagtgccagtgcctggcaaatacagaagtggatgctcacagtcatccattggacagagcacagggtccccagtgacagagctagagaaagtacccaaggagctgaaggggtttgtagccccataggaggaacaacaatatgaactaaccagtacccccagttctccctgggactaaaccaccaatcaaagaaaacacatggtgggaattgtggctctagctgcttatgtagcagaggatggcctagtcagtcatcaatggaggataggcccttggtcctctgaatgtactatgccccagcataggggaatgccagggccaggaagaaggactaggtgggttgggtagcagggggaggagggagggtatgggagatcttaggagaggaagctaggaaagggaataatatttgaaatgtaaaaaaagaaaatatctaataaaagaggatgaacttgtagggcatgcctttaatcccagcacttggaaggcagaggcaggtggatttctaagttcacagccagcctggtctacagagtgagttccaggacagccagggctacacagagaaacactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagagaaacactatctcggaacaaaaatgatgaactcatgtaattaccaaacataatgaagtcttaacacagaccattccaatcaaacacagaactcagcatcattttgctagaagactcccaggggagactaaaaactagaaagtgagatgaataaaaattgggcagataagtgatgaaactgggtaatctttcataaaactacaaatttaataaaaggtaggtcattggagcaagccaactctgtcttgcagagaattctgaaaacaagaatgcgtcaagaagactattctctcctgggagaaagcaatattgaaactatgtatagtggctggaagaagggttcagttgttaagtgcttgccttgcatgtatgaaggcctctgttcagactcacagaacccatgtaaatatgatgtgggtgtggcagcctgcctgtggtttagcttgggaaggaaaagtcacgtgtacctgcaccagcagcagcagcagcagcagcagcagcaacaacaacaacaacaacaacaacaacccagctaaatggactagctgtatcagaaaaccctggacttcactgagagatcctccttcaatgaataaggtgaaagaatgattgaggataatttcaaaattaaacccaagtctctgaatgcatgcacaaccccatgtatgcatgcatccacacgatcatgtgcccatgccacaaacagacacgccaaatacatgagcaagtgagaaaagcaaataggagaactcccatctcttcatcttgctgaaagactttgtaacacattttggtgttgaacttcatccatgacccattttaagtttataagacatgttacatccaatggtagctcctttttcttcacttctgtcactaccgctaaattcttaacacatataaaacagtaactcttaaaggaaaaaacaaggaagcaggtgtggtggctcatggcagcacgagagagagagagagagagagagagagacagagagacagagagacagagagacagagagatagagacagagacagagagacagagatagacagacagagagacagagacagacagagagacagacagaaagagagacagaaagagacagagatagagacagagagaggcacagacagatcaggataaaagtgaggcctgcctgatttatagagaggtccagagatcgaacagacaaataaagtaaaatgtgtaaaaataactctctccttttccagagtgggttttatattttaattttattatataatatgttttactctggaaaaatgttacactggtgaaaaaaaataaagattattgaatcatcaatttgcataattttaagtacctctatttgtataatttgtgtgagttgtgatgattatttcatcgtcgccttgaattctgttaagtttgtttattttatttaagaaaaaaatcagtagtgacaagaaacaaaattcctttccacattcaggacaaagcctgttagtactcactggttactaattatagaatattcttcgttgattcactgacaataaacacacagtgaaaaatatttttgctcaaaataacaatttctcctaaatagcaattgttcaaacatttttaccttagcataaattaatacatcctatcttctcttgcaaacatactctgagaggatattaacagattccaggatgtgaaagtaaggcattaaaggcaacactatactgagcaaaataagtttatccagaaacaaacagacaaagaaatctgctgctttctttacttggcagaaatcctgacctgttcacaatggctttttaattagtcattgcattttgtcaataaaattactgtctgatagtcgcttgagcacaaaaattaagcattaagcaaatgttcagttgatcatctgtagatcttagcattctgtctagaacaaaaatcattcaaggtcacagagtagggctggagaattatcctgcagtagctgcagcttctagatcctctctctatcagtggcagctgctgtggacacacagaggaggcaacaagaaagctcaacgctttactttcatccattcatctacttgggtcttggcacactctaaagcccccagctggaagcattacaccactagtagtttaaataagtaagtatagactcttcctattgatggcaaacacatacctctgtttctttacactctactggatgcttgttttcaaaggcaagtgtgtgtcaaaacatgggtcttttttcccagagatagagcaatgactgaaactgaattgatagctctgtttctgaaagcatgtgtgctgtctgggttcaccgttatccactcaagggaaaggctatctctaggtgctgcatagacactgtgccagggctaacaagaccagtcagcggctgtggaggtctgttagttcattactgatgctgttaagtgtacacagttgaccagaaatgccagggacccataagcactaatgtctttcttccttcacgaatgctcctgcaaggtgttcaagttctattttcgagtttacatgaccaagttccaccataacatgtaggggctttccttttcttcccatctttctgcttctccatagcatgggcatgaaagcaattggaaacccactctacatgctagggaagttttcttccattctttcttcatgcttcaaaatgactaatccagtctacgtgcattcttatgggagaataagaccacacattttacaagaaaatgagtatcttttctcatggctctagaggctaggagctcaagatcaagatatgggcatttgatgaagactttcttgctaggacctcacatgacacaaggttgaaagaccagggtgagcactataagaagcctctttcataagagtttcaagacccttcatcaggggagaagctcctatagtgtaaagacacttcttcaagactcacttcttattgctcttctattgtcaacaccttttagaagaggcacctttaaatctcaacatgtctgccatcagaacttttccaacttccccgctaatttcccaactaggtagacttaaaaccattatcatcccttcaaaccccactgtatttgaaataatcaaacatacactgcaagaatgctcattatattattaagtatctgctaatatacctttcccaaattgttaagttcaattgataatttaggcaaatatatatatatatgactagaaaagttgactctgcatgtcttcttccatgagcagtttcatggatacccagtgaagtacacacttcagcccctttggacgccagcttagctcctcatggtgagtatctgtggtagatggagtgacccagaagaatctctgatgaccttctaccgtattgaggtatggcagatcagtattttaattagctgaatttcacctaacatgtgagattatggctgttatttagaagtatgtagattctgttttttaacctatcaggacatttcactcatttggtaactgttagacagatcccagagccccagccttgctgtacctagatctttagaattaagttgcatgtagaaccatttccttagcccagtcagctgttctgagaccattaaaattaagataattttccgtgtaatacatgaaattcagttatgattttatgtctcttgatcttattgaaatgagtgtcaagataaattcaagtgttgtctttacatctctagataccatcatcagtacaaccacagaatttccaaatgtcctcacaactgcaaatggaactactaaaattgaccatggacctatcaccagtgagttgtcttttattttatgttttgttactcagcagatatttctgagcacctttccagatactctcactcttgctgagtatacagggacactggcatctggcagattctggtctactggggatgaccggtaaaaaggaaatactgtacaattaaacttgtttgtgacaagagttttgataaggtgttttcagaatccagaaagacctggttttaactagaaaatagggaattcgctaaggtgcttatattttcagtcaaaatctgaaaaaagggaaaggggaataagaattagccagttgaaaagtagaagaaaaactgtgaaaaacataattcgagtcaagaaagattgttaagataaagagtacttctggagctcaactaataaaaattatgtctgtcagtgcaaaatgcaattccttgttttcccatcttgaaacaagagcaaaggattcagtgaagtttgaacctttcacagaaaacatggtcattaaaccacagggacacatgttcatttagtcatagaaaactactgacaagataattaactattttttcccattttttattaagtattaagctcatttacatttccaannnnnnnnnnnnnnnnnnnntaagctcatttacatttccaatgccataccaaaagtcccccatacccacccacccggactcccctacccacccactcccccttcttggccctggcgttcccctgtactggggcatataaagcctgcgtgtccaatgggcctctctttccagtgatggccgaccaggccatcctctgatacatatgcagctagagtcaagagcaagattttatcgaaaggacccagatgtagctgtctcttgtgagactatgccggggcctagcaagcacagaagtggatgctcacagtcagctaatggatggatcacaggactcccaatggaggagctagggagagtacccaaggagctaaggggatctgcaaccctataggtggaaaaacattatgaactaaccagtaccccggagctcttgactctagctgcatatgtatcagataattaactattaagttgtcgtcttctataagaaggaacatatggccatggtccatgaataccccataatcctttgggaaagcatctctttcatatgaaaagttactgtttttatgatggcaccttaggcatgctgatcagtgggctatactgagctagagaagtcccccctgaaggccgtgggtgtatgggaaagaggggggtgggagagtgcccacatcaagccagagttctggtgctctgggcaggcagactcaggaggacttcacaggctttccacacagtcctgggtgggcatctggctgtgttaagccactgaccccacacggtgggtagtggacaagaggcagccctaggtaccaggttgtcagtctccggcatcccacactggatatggtagaggagctgagaacagaataggggccccaggcggcactcagctccagagataagggaagagggggcagggggagagggagcactggatggttcccaggcaagcgagagtccttagtccggttcttggctggagcacaggaaggccttctgacgggaggttagacatggctccttaggagaaagtctatcccaccattcaagcacagcggacattgatgaacaaagacagtctttggttttagagctttattgaagaaaggcagggggaaagagagaaggtagaaagagagagagaccggccatggccacatgaagggaaagagagaaagagagctagagagtaagaaaggtgaaagcttagagagagaggaggggccaaacagcccctctcatagtgggctttgttatcttgctgttgctaagtaactgtggggaggagtctagccagaatgctagaagcttaggaaattgcctacctaactgatatacacatgtctctcctgtgggggctgtgggggaggtaacattgacaggagcctggagtccaggagacataatcaaacaccttctgtcccatgtaggtggaaattaccacccactgggtcccactcgggttcaagacctatgctcgactggagaccaggctgtgtgtgcatagcctattgcccgaccccccccccaccccatttatttttccaaatgccaaattttggcactgaaagatccacaacgtgaggacctccccacattctgactcaggagaggcgacaccccaaatcactcaagaaacggtcttgctgtaaactgcaagaggactttttatttcaagagcactctcgagcccacagtcatacaccatgcaggggtagaggaccgtggtgccccgagtagctgggtaaggggttatttaaaggaagaaaccacaactcaaggaagtgggaagagtgttgttggaaaataccaaaaataccagttaagagtctcgaggaagtggaaagtcaagagagttttctaggagcctctaacaatagcacctgtgcatagcgtattccagcaacagtcaaggtgggtcagagtgactttctttgaatgaacacttcctgaacccaggaagcgggtgggtggaggaatgtcactatctgttttatgattagcatgccttggagcattgagtcacaaaggtcacattctcaagcctgggcctaaaggcctagaatttttgtttttaccttataatttttcagcactaacctctctttttataactacttcaggtatcatagttaatcaacccagtgatggaatgtcctggcctgtgcttgtcgcggctttgctctttttctgcacactattgtttgggcttggagtaagaaaatggtatcggtatcaaaatgaaatgtgagtatatcatgatatgtagacactgaccattttccgtcataaaatatttacttgatacaaaaactacagggccttcctctcttaatttaatgagcaagccaggcttctagaacctcagagagtgcatacagtcttcccaagatcactcagtgagggctcagcccacagctcctgactcagtctctctgtctgcaccagcttgcttctctggaacagcagatgctgtacacaggtcagtaggtatgaaacaagaacagtgcctcccctcaccacagagataaagctgattgttttcttttagtcttcattattttttcattttcatgcatttttaacctaactgggatcagctgggcccagatgctcaagtgtgagattgaataagaggcgtaagttttaaaacctttgcagctgctctccactggggagggcttctcctgcctctttcctcttttccacaagaggtggggggagggctacattatttttctaaattccctatttaagaatctgaagtagcatgtcaatgtaaagctcctttctgattcagctattggagatgagcctggactaggccatgatgacaggagcccacacaacacacagtgctgatctccttaggtctgctccctgctataacaaccatcactgcacaacctcctcttcccgcgtatccctgaagagtataacaggtatgccaaacaggcatcctacctaccacatgcatcccaggaaagctagaaatatggcccaatgtgtctgaagatgggaacatcatgttgtgacgtcaaagtggatgctcctgctctgtgactatgaataacaagtgtttcatgttaattaattaaaaacaaaaccagctggccagtggcagctcacacctttaatcgcaacactaggaaggcagaagcaggaggatctctgtgccagcctggtcttcagcatgaattccattccaaattaggatgcttttgattgtcagacagctagagccacacagagaaaccctgtctcaaaaaaaaaaaaatcaatattctatgttttatctaaggactgtgccttggccattatatgactgtaaaatgtttgtagtttttctgggaaaaaaaaaaaagcacaagtttcttatattgaaattcaccttttgatacagttccaagcctccactgaagcatccacaaacaaggtaacaagaattacagattaaaggaatggaaggatggcccagtgcttagggcttcggagcgcttgctgtccttgcagatgacataggttccattcccagctcctctgtaactcacagcctcatggagcatttgctttattgcctcttctggtctttgagggtcagtgcactcctacttggcatgcacatgaataaaaatgcatctctttaaaattggggatatttatattaaaataaaatggaggaccaaatagtgagcttttaattattctgtttaaatgtattataagaggacaaaatctgcaaaatattctttctctctctgtctctctctgtctctctctgtctctctctctgtctctctctctctctctctctcctcattctctttgccaaatccctttctaaatttggatgctgttgattgacatagcatgaacataaaaaaaaaaaaggcagatatgtccctattttctgttatcaaaaaacttgaacattggcacagcaaaaccccacactaacctgaatgtttggcatacatgagacagaggtacattgtgctaacatgaaatagaactttgcacaaaaacatcttcaagagtgcattctcctgccaactaagccaggagtaggaacaccttgcctcccacccgtaccagatcctcagtgtgtacatgagtatatgcataaaggctgagggtagagttagcaaggttgctatttgaaaaagtccttgaatttatgtttctgtctcaggagggatgttctacccgtgtaagagtaaaacttgttccattaggaggcagttgccatggagattatgggatctggttacaagacttcagttgctggcctgcttctctttaggaagtgtcttaaaacctctgtacttcagctctatgtgtcaaacagtgattataatatttcttaggtacaaactaaatgatggcaggataaaaatcactttgtaaactataaactaccacattaataataataatatatatttatattttatattttatatatttatcatattgttttacattatgttatatcacatcacatattatattatatatacaattaatagatagttagataaatatatatacaataccatgttaattaatgataagatcatttgcagggttaagctgccagaaattctatgaaaatgaagattgtttctcttcctcataagtatatatctaatttaaaaaataccaccctatattcacagcactgacaaagaaatgttttcttcgcagcatggagagacccccacctttcaagccaccaccacctcccatcaagtacacgtatattcaagaacccattggatgcgacctgtgttgtcatgagatggaggtcctctaagcttttgagccttgtcacagcgaagcagtgctggagtcctgtaggaagggagatattgtacaatattaatatcatcaccagccaggcgtgcctctgcttcagctcaaatgaatgttggaaataaatgacttctattcccagcatactgccctctttcatctgcaaacacctgagatgtaaataagcattagagaataaagcgatgttcacacccagcaaaagttctagaaacctgcttgcttatgtaagaagtataatatcaggctgctgtcattttttaaaacttcagtctctccacattttatttcaatactctaaattgggggaggacagtgatttctggcatttgttttatactggttaaattttctagtggcagtgaccaaattcccaacagtaagcagtttaataaaagaggggcttatgccagctcatgatttgggggggtacagtctaccagataggtgaaaggcaaggtggcaaaggcatgtggcagctgcctgttactcgacactggccagaaaacagaaattcagctggattcagagcctacgtgtaacccttcagcccctcctgtctccccttatatctgccagtcagatcccacatccaaaaggttccatgaccattgggcatggtcaacagctgagggccaattgtataaggataagccctgtgggagatacttgaccaacgagccataaatgtttccacacaaaatcttctgaatgttttctatcatcctaaacgagctgccaaaattgtgatcctctctgacttttgtggattttttttccccctgagacaatcctaagaccaaaacatcaaagttctaacagtaattccaaatgtttgagaaagctgttcatactgaaattctgtcactctctttcactgaaggaaactccattactctgtacattcccaattctcctcgacccttcctctctattgtgttcagcccaggttcctgacacacataccagaatggagaaagattaggaagataagtagcctgcaagccagttgccttcttgatataaaatctcctggcttctaggactaagaacagttttattctctgttttgactgtgtctgtgtttgtgttcccatgtgtgcacatacatgcatgaatgcatcaccctgctaagacactcttacataaggatacaggcagttcaacctctgtccaacgcatctgattttcattattcttgctttaatttggagactgtcctgttcattcaacccactgctttggccaatcctaaaacagagtagattcaaagtgagggactgacccttatcctaccaaccttttctgaaacactttaagcacgatttaccagtgaaggagaaagcagtctccttagtcaggcatgctctgtgttcagcaacactttgcaactgaataaattacagatctcccttgccatcccaaactctcccacactcattgccccaggagagaagaacagatgttgttgacagatgcaatcagaggaaaatatttggttggactttagtccccaggagagccattttattcattgacaatgtgcttatccctgactgcacaggaaaacaacttcaaatttgtgcattctaataccatctaataccactcccaatcctttaaaccttcctgtctatggagtgaggtgccagcatcatcatctctctgccgattcacgtggtgagacaaacacgagaaccacaaacagtgccaagtctctgctcacagatcagaacctaagatatacggctctcgtggtgtatagccccaagatgaccccagatgatccatgtcctttccaggcacgttcaacttgtgactcataggctgcattcatcccgtgatagctagggatgtgacccagcaaactctacttgcagatcacagtgtcaaatcacaatgtcagaaggatggacgcctctgcatccccaccaacactacgtgcaactatcttctctgtattgaagtgaagcactcaggatgcaaagttgattgacatgactgcatttgatctcatccagttgcataaacccaagagttactgactggcccacccctggtctaaccaataagatacttcagaaatagccatctctggagaaagcctagtctcatgccacaaagacaagcagccgtactgctctacctgctccagaactggggcttctgttcacagagtccatcaacttacataataagcaagtcatcctgttacctgacttctacagcttcagctgatgctatggcttatgaaaggcacagcaccaatctatgcttctccaaaatttaggacctgttggtaccataagagaaaaaaagcttgtttcataccaccaatttggggtctaatttgccacatagcaatagataattaatacagctcaacagatgaagaaataatgttaaggtcctttaattattctcatttcgtaagaggtgtgctgatgttttcaggtaagctctgaagtgctttatttggtcttatttagtcttgttctggtcagcatttgcaaagtcagctactgtttgattagaaaaagcagtcatgtttctgctcactcagtcagtgattcagagaaacgttccacagtcttgaaaaatatggggctcgggcgccttttaggtagcattgtgagcttgatgtcccttatttgggcaaactctaagtattaccagatacagcttgaagcatgtgcaagtaaaaccatacagccagcctcaaacagcaactcaactttcttagaaacagattcagagccaggagtggtggtacacacctgtaatccatgtacccagaaggtgagggcaggaggagcaagagttcaagaccagtgtttactacataaagagtttggtgctagtctgagctatatgaagatcctgtctacacacatacacacacacacacacacacacacacacacacacacacaaactgaagtatacagttatgttctgtacagaagtatcaaagttaactctgtagtgtacatgtcttcaccaccaccttcatttttactaggaaaaagccatatagacatgttatgaccagtttctgagtcaccctgtcttctacagcattgatatacagacaaagcaagtttctcatgtctttgcaccattatcacaccttgacaatgatcttggccatgtaacttgttctgatcaatggaatattatagtatatgacaaagtcaaagtgggaaaactgaaagcatgttggaattattcacttttttagaaaaagatttataatttattttatgtaaacaagtgctctgttttcatgcacactagaagagggaatcagactccactacagatggttgtggtccacaatgtagttgctgggaactgaactcaggacctctgggcgagcagtcactgctcttaactacgaaattatctctccggccctattctcttgtgttttcgcattgctatgagacatgttcaagataccttgataatacagagaacaaggtgagaaactcatggtatagaacagacccattaagtcaagcctaggcgagaccatccaactcctcagttatgacatcatgggtcacataaactaaatatttgcatatcacagaaattttatgattgccatataacattgttgtagcaatatttaacttgtatatacagatcaggagatgtgtatatacaagttattaatggcaaacactcacgcttagggataaagagtattccccaatcaaagaccagctctttctctgatttagcctacattttatttctaagtgaagaagatatcttgcccttaccaaattcactttgtattctaagtctttaaaatcacaggatccttgacaaggggtgaaggtaaaggtcattttacaaataaaggggtaaagggtccactgcattgactctcccaaggtcacacaactggaagaagcaacaccaatgtgatggcccagttctctccttcccacctcctgtctttgattgtgtccataccccttttattttcactccagagatggcttgtttcctataggtttaagttactactgattttttaactatctagacaatttatttcaaaaattgtgacagaaaacagaacagaacaaaggcagaaacagttgttgccccaaggatgggatggcctagaaagaaggggaaatgagtaggtaaacaaaaaaagagaataattaaaaccggaaggtgaacagaaagtctagaaaagattaccaaggttagagatgatgtaagagtgtttctcaaaggttccaaacaaaggagattcttggaagcagatttgtcttgaacccagaggctgactctgcagaaacctagagacttatcttctgaggcaggggcaaaaacagtgtgactgagctgtggacagtagcacgaatgactatgccaataacaagaggatgagaatcacctgcagaggcagctgcaatggcaagtgagagtaagctccacggaatgaaagccacaaaccagcagaaatgggaggactctccagccggaaacaaggggccagaaagtagggagaatgctattcagctccagctcctgcaaggcaacctctgtccagatgctgcagttactaataaggctgcattccgcatgcagagggcattgccagcaggacctcggcagctgagaatacttctgaaacttatcccaccaagtgtaattgaggatgaatcttgagattagtcacagaaaaattaacataggaaaagaaatgaaagaatctaatgtttgttccccagagagcctctaaaaccctttaatcacagttcaattatttgtgattctgtgtgtgtgtgtgtgcatgctgaaattgtgatgggtgggggttgtgagaacccagtctaacaaaaccaaaaacaacaaaccagatatcaagatataaacaaaacaagggtggggcccaaaacagacactcttgataaatgccaggaaccagtgcccatttgccctgaattttgtcaaactatttctgatttattctctcaggaaaacatatcactaaataaaactggcaacaagggctggggatgtatttaacttgtagagtgcttgtgcagaatgctgtaggcccagggcttcagtcccaaacaatgcataaacaggattgtggtggtgcacgtccatagtctacacactcaacaagttgacccaagaggatcagaagttcaaagtcaccttcagtacgtggtgagtttgaagccagccaaggctacttgaagattcctgtctcaaaaccaagcaaaaagaaagataacatcagaagcagcattctggcactcatctattaacaagccatgttcagaagcacctgaacaagtgggtcaaggacacagtgtcaggcatcttaattttgtcatgcatctaacccactaacgtaaggatggtgcacaggagttggtgtctgtgtgcaagatttcttcttacacacacacacacacacacacacacacacacacaccgtgaataataataataataataataataattaataataatgtgagtgataattaataacacggtaattaattttaaattaagaaaatgccccgtagacatgccacaagtcaatttgacggaagtaattcttaacttgaggttgccatttcccaggtatgttgacatgagttaacaatgaaagctaatgagattgctgtcaaggttgggagggtgggcacattcctgtattgctgaagataatgcagaatggcatagatgcttctgagaggtatttgacaacatctaacaaaactgtgttttcatttccccattggcctggcagttcctcaggaggagctcgcctcaggttctccatactgacaaactgtatagacatggcttattcttggcatcactttctgtacttggtaagtataggaaaccatctgaatatctaaacatatgagattggctggataaactattataaatacttaaaatggagtgatgttgtgcttgtcagattcttgttagtgtgacaagtatctgtaataatcaacttgcgaagtaaaaggggcttgatttgtctctcagcctatcgcatctgagcctgtcgtgaagaagcacatcatggcaaggcgtggagtgtgacaaatttctccctctttagccaaaactcaaaaggcaggcagaaaaggggagtctgggggtttagtcctttataagcagcatactccctaaggagataatagctaccttttagaggccacctctcaaagctcctagggactattcattttacacataagcccctggagacattgaaaataaaactacagcaagtaagcagctcctgagagagagaaagagaatcttatcaactgagaagaagtaatttttatgagatattactagctgaaaacaacaaagtccaaagaatatgttatgttttctttatatataatgaaggaagaatgaaaaaaatatttaatattttgttgcatctatacttataatggttcagcttgtagttttcaactttacaatggtaatttttcagttttatgatgatgtgggagcaatatatgttcagttggaatcttatttcaaattttgagctcttcctggaagagaaatactcaatgtgctgttttctggtgatactggtcaactccagtgaggtgcaatgaccagttacctgtattctccacccaggtagcagtgaagaccctatactgttctatggtaccaagtcactctgttcaatgcattagctgtgttgagtgtactttgaaattgtgttattccaactgatcataggtttattaagagataagctgcttatgtagtcatatgttagcagaaggaaatgaaggaaaaataaaccaagaaaatcatggggttgcttctctgtaaagataaaggaaagactgggttgaaatgggaaggggatgtctacacttctcagcatacttttattggatagaaatatgttaatatctgacccactcaaataataaaattaaaaacagaacaaggaatgtaagcaagagcatcgaatgaaaatggaaacagactaatccacttgcatttcagataaataccacaatcacaatgaaaggaaagaaggaagaactaatccaagcatttaggcagtcaatacttatcactcattctcattttgatgttgggtagaggtgagagagaaacgggaaaactggaaacaaatctagaatcctttgtaataaggtttatttttgtttggctgtggttataccagcaaagcaaaattttaaactactttgtatatataatagaactgagtgaatatataaatatattgctgttgagagttcccgttctgactctgggagaaggtactgataatcgtgaaatatgaaaaggaacaacaacaaaaaaagcctgtatagatataggaatgggctcaacctagacccagtaagaacttactacttccttagtaatatgtgtgtgtatgtgtgtgtgcatggttatgtgtatgagtacatgcatagttgaagattcatagttgctcttctcaaataacataccttgaggcccatcttgaggttcatctgtatcttatgctgctgttgtacatcttagccaaatctcgtgtgtgtgtgtgtgtgtgtgtgtgtgtgtgtgtgtgtgcatgggtgtagctgtgtatatgaagagagactaactcatgcgatcctgtcctctcctatttcacgtcagtcccagagatcaaataggtcagaaggtctggtgacaagcatgtttttctgctgagctacatcagcaacctctaacataattttatactgaaaagaatatgtcatagaatttctcatagaaatacctagtcaaaaataactaggcataaataggtctagaatgtccatttggaatgatatcagacaataacatagtccaaaagtatttcaaaacaatgaaggaagcagcctgaagggaatccacaagacagccctatgataatttgaatgccagtataattaagcataataatggtttcaaaaccattgggtaaaaacaaggattcataaatctcttgccagtcagctgattggggcatgttgcactatttcattggaaattgtgtatggctgaagggcagcttcctcaggtttgggagtcactcaggccactgagtaacaagggctcatggaccaaagtaacaacaggcttagagtttgaagtctctgagttctgaaaaccagtgacaattgatggtacttagttccttaagaaggatccagttcctttcagacctgccacacaaattattgccaaaaacaggcacagacatatatggcaggtaagcaagtgagatcacagtagactactgaaagtagcctgggaagtgtgaggggtgtcctagaattggaaggttatcattttgtagtcatcacaataactgaagcactctagaatcattcaaaaatgctaaaccaaggaggaagtctgagtgaagaacaggatatttgtatggtttctgtcttcctgtagatgctcattatgggcagcagaagaaaaagaagcagtagagacatcaaacacctacctgaccatggtatgtctccaccaaaggacacagaaatactgtgccccccccccacctgtctgtctaggaggcacacatctcccatgcagtcttaggacagagaaggaaaacactaactccagccacaaagtaacaccccattaagacatgagaaacaaccaggtaagagggaaaaggtgctttggttttgtctttgagatggcccaatgtccgactgaaatagacaaagagagtgagggtttatttagctcacaggttcacaggtctgcatccatcactcttggctacagtgagcccatgacacaggaggcaaaacatcatggcaaatgggtaaaatttggcagtgacttttcatttcacggcagacagaaagattaacagtgtggaccaagcctaatactaggaattcccaagcacccacctcctccagccagtcctcagttcctagagttttagaacatcccatgatagcactactagctagacacctaagcttggatacaggagtctgcagaagacattacttattcaaatcagaatagaggagggttatatttttcaaaagtgtcactatctaaaagacaaaaaaaatcttctaaaaatattttagatagggagagagagagagagagagagagagaggagagggaaaggagttgcaagactgggtcttctgctaaaaagggagaaatactatgaagagcagtgttagagcagctgagaacaatacagtgtgggctgaagacctgcaagacttgcactaccaacttgactgttgctatgctaagagggcgttactacttgtaggaaatatgtattgaaatattgaatgtcaaaggcatatgcatatacacaaatcatcgcatgggtgcctttgcatggtctgcttaaacatatacaaatacacacatccacagcagagaaggaagcaaatgatgtgaggggaacaaactatttaaagaaaaacagtctaacctgggactaggaaaacattgccttacttatacttatttatttcagtcctgttctaagtttgaaactattttcaaatacaaatttgttttgttttgttttcgttccaagagagggaactcaatatgctacccagggtagccacagaaagtataatcctcctgtccctagctcccaagtcctgataggaagtttgaataaaaagtgcctaagcaaggacctaagagaagatgtttgctgattcacaaatagcctatttctccaacatcaagagtcaggcatgaaggcctgtttctttgggctgagccttctgagggagcattccctggtctctgagcatggcttcatcagaaagttcagaaggacatgaaggaggctttatctggcaagctcatccttttcctttcatttctgagtcttgttctgccctcggcactggctgggatccaccaaaacttcaatcattttttttctttatttcttaaggaaatgaatactgttctttgattttcctaaaactccaggacagacttagcctctcccccactaaactatttcatatcaaaagaagctaagctgtgtctggccagccttcacccaaaccctgtggcaatgctttttgttgctaccttagtggggactatggaaacagggcacagtttacatcagccccacagcaa

SEQ ID NO: 8 - DNA, 2046 bp, Mus musculus
gagctcttcgggagacaatggggagaaaatggacatattgtgttgtttacaccatcatccagatacagtttttcaggggagtgtgggaagagctattcaatgttggagatgacgtgtatgctctacctggttctgacatcaacttgacctgccaaacaaaggagaaaaacttcttggtacagatgcagtggtccaaggtcacagataagaatgacatgattgctctttatcatccccaatatggcctctactgtgggcaggagcatgcctgtgagtcacaagtggctgccacagaaactgagaagggtgtaacaaattggactctgtacttaaggaatatctcttctgccctgggtggaaagtatgagtgcatctttactctgtatccagaaggcatcaagactacagtctacaacctcattgtggaaccctatacacaagatgaacacaactatacaatagaaatagagacaaatcggactctggaaataccatgctttcaaaatacctcctcagaaattccacctaggttcaccttttcatggttggtggagaaagatggagtggaagaagttctcttcacccaccatcaccacgtcaacaattccacatcatttaaaggcagaatcaggctgggtggagactatagactccacctctccccagtccaaatccaagacgatggcaggacattctcttgccatctgactgtcaatcctctcaaagcctggaagatgtccaccacagtcaaggtttttgctaaaccagaaatcctcatgactgtggaaaacagcaccatggatgtcttaggagagagagtatttacctgcctactgaagaatgtgttccccaaggcaaatatcacctggtttatagacggaagatttcttcaaggcaacgaagaaggaatatacattacaaatgaagagaagaattgcagtagcggattttgggaactgaagtcagttttaacaaggatgcacagtggaccatcccaatcaaacaacatgacagcttggtgtatggctctgtctccaggccccagaaataaaatgtggaatacttcatcacaacccatcacggtttcctttgattcggtgatagccccaacgaaacatctacccactgtgacaggttctaccctgggtacacaacctttttcagatgctggagtatctcctacagggtatctagctacaccttcagtgacaattgtagatgaaaatgggttgacaccagatgcaactcctcaaaccagcaattccagcatgactactaaagatggcaactatttggaagcctccagtgggacagatgccaagaactcctcaagagctgctgcttcttctaaaagtggatcttggccttttcctttcacttctcctccagaatggcactcactgcctggtacctccactggaccccaagaaccagactccccagtttcatggatacccagtgaagtacacacttcagcccctttggacgccagcttagctcctcatgataccatcatcagtacaaccacagaatttccaaatgtcctcacaactgcaaatggaactactaaaattgaccatggacctatcaccagtatcatagttaatcaacccagtgatggaatgtcctggcctgtgcttgtcgcggctttgctctttttctgcacactattgtttgggcttggagtaagaaaatggtatcggtatcaaaatgaaatcatggagagacccccacctttcaagccaccaccacctcccatcaagtacacgtatattcaagaacccattggatgcgacctgtgttgtcatgagatggaggtcctctaagcttttgagccttgtcacagcgaagcagtgctggagtcctgtaggaagggagatattgtacaatattaatatcatcaccagccaggcgtgcctctgcttcagctcaaatgaatgttggaaataaatgacttctattcccagcatactgccctctttcatctgcaaacacctgagatgtaaataagcattagagaataaagcgatgttcacacccagcaaa

SEQ ID NO: 9 - protein, 605 aa, Mus musculus
ALRETMGRKWTYCVVYTIIQIQFFRGVWEELFNVGDDVYALPGSDINLTCQTKEKNFLVQMQWSKVTDKNDMIALYHPQYGCGQEHACESQVAATETEKGVTNWTLYLRNISSALGGKYECIFTLYPEGIKTTVYNLIVEPYTQDEHNYTIEIETNRTLEIPCFQNTSSEIPPRFTFSWLVEKDGVEEVLFTHHHHVNNSTSFKGRIRLGGDYRLHLSPVQIQDDGRTFSCHLTVNPLKAWKMSTTVKVFAKPEILMTVENSTMDVLGERVFTCLLKNVFPKANITWFIDGRFLQGNEEGIYITNEEKNCSSGFWELKSVLTRMHSGPSQSNNMTAWCMALSPGPRNKMWNTSSQPITVSFDSVIAPTKHLPTVTGSTLGTQPFSDAGVSPTGYLATPSVTIVDENGLTPDATPQTSNSSMTTKDGNYLEASSGTDAKNSSRAAASSKSGSWPFPFTSPPEWHSLPGTSTGPQEPDSPVSWIPSEVHTSAPLDASLAPHDTIISTTTEFPNVLTTANGTTKIDHGPITSIIVNQPSDGMSWPVLVAALLFFCTLLFGLGVRKWYRYQNEIMERPPPFKPPPPPIKYTYIQEPIGCDLCCHEMEVL

SEQ ID NO: 10 - DNA, 130505 bp, Homo sapiens
  misc_feature (1)...(130505): n = A,T,C or G
gagatcctcctgaattaatggggtgggccttaaatccaatgactaatgtccttataagaaacagaagaggagatgacacagggaaaggaggagaaggccatgagaagactgaaataactggaatgaagctcacagccccagaagctggaagagtcaaggaacagtttgtcccctagagcctttggaggaagcatagccctgctaacaccttgattttggacctctagtcttcatatttgtaagaaactgaatttctttgattttaagccaccaagtttgtggtagtttgtgacagcagtcctagaaaactaatacaacatcttataccatttaatcgttacataaaatttgtgttcttaaaaccctcaataggagggagagtggcatcgagatacttatatccctaggtttctaactgaggggttgccaaggcttggctacacatccatgctgaaggccacagttcctgttgggaggctctctccctgcagctaccctctctcatggctgtctcccatttccctgcagtcataggaaagaaagtggcttcccaatgttgctagcccctaagaactatgctacccctggtctcccctaagccctactacatctttatatatagcccctatattaaactctattcaattatcacttttgaatgtgccttctgttttctactgagactagactggcttgtcaactctggggtaatttagctcccagggagcaatgacttcagtcaatgctaagccactagtgacagcaaaagttgtattgcagcttttctgagattttgtaatattatgtgcctatatgtaagagacctggattttataatactcattttcccatagttatagcattagatcctttaaccctctggctttcaaaaaaaagaatcttgtcattggtagagataggtttgtcatccttatttttatctatcttaagtactgctattgaattccatcccttaggtaacaagaatttctctattttctacagttgatttgagcacttggaaagccagtcacaaaatgtcttaagatttatattctctctggcagggcaaatatggtctgcttttttatgtgctgctaatttccttcatctcacatactccacaggagacctacgggtgataattggtggcagatctaatgggctccttgaactgctcatagctactctgggcatccctcttcttgataacgctgagataatatcatgggagaagagatattatttatctttgtctcctgtacagatcaatcctagtgccagacatttaagtggagctcagtatttgttgagacactcagcaaaattaagaatatatcttatttttagaactctgactagtttatttcaattttgtggaccttgtgaaatgtgtatgctgtattatttctattgatgggaaatggatttacttactcaagagtttcatcaaaaaatattcatatagtgtctattatgtgctcaataccattctcggggctagaaatatagcagtggagtaatcagacagccttagcatgcattctccacaaaagcacagcctgagacaagggcctgcctacagttactttgggatgtaatcgcatggaacaggagtgggggtgaaaaagagtgaaacagggaaggagggcaagtcaatgcaagggtgcaatatcaagcagcttacactatggtccactgttgtctgggtccctctgggcactttcttaggatctgtgtagaacgcatcttagaatctttcacctgagcaacacaagctcctgttccccattgatcaaaggttgcccgatgaggtgttgactccctgcacttccaaggtcacgcatgtgtatgcatggatgagtggaatgaggcctccacccccacctatcccccttcccttgctgaggaggcagagatgcccaggtcagaaagtaagagatatttagggcagctgaggagaggtgctttcaggcttacatttgagcagcctgttggacccatgacagctggaatgaaaaggtgggtgtgatattgtgatgtaataagaattatgtatttggtctctgtccccggttcctggcacacaacccctgaaactcttggaacctcttaagtgatagatgtctttgtgtatgctagcaagatgactgatgactggggcctctgggatagcctcaggatgggaggctggttaccaggggaaccaaccatgtgattagaaggttgaaactttcagccccacaccctgacctctgaggaggggagggggcctgaaggttgagctgatcaccaatggccaataatttaatcaattatgcctatgtaataaagcctccatgaacacaaaaggactgggcttggggagcttccgtattgctgaacaggtggaggtgctgggagagaagagcacctggagacggcgcagaagccctgcacccttccacataccttgccttatgcatcttttccatctgctggtcatcttcatcttttataacattatttacatgggtaaacataagtgaactgtttccctgagttccgtgagccaccctagcaaattagttgaacctgagaagggggtcatgggaaccctgaattatagccagtcaatcaggagcacaggtcacaagctgggacttgtaactgacatctgaagtgagagacagtcttttgggactaagccctcaatctgtgagatctgacactatatgtgggtagatatgtgtcagaataaaattataggacatccagttggtgtcgactagaaaactgaaaaactgcttggtgtgtgagggaaaaccgccagacagctggtgtcagaagtgaagtgctgagtgactgcaagggagtaggaaaaccacgttgatcttttcctaactttaatggtgggttgcaaaaatgtttggtgagtcaagaagtgactaatacataaagctcctgtccttcccaggcaaacgctctagtggaaagtgacaatataccaaaaaaacaaataaataaataatcaacttaatgtctcatgcaaataagccctgtgaaaaaaatacagttgttgctgtgacagaggcccatgacagggctcctttagatagccatgaaattcaggaaaggcctctttgaggtgaggacatttgaacaaccacagaatgagagaaaatattcatgtatgtagcctgtggaagagttttccaagcagggcaaatgcaaaggccccgaggttggaaggacacagagagcttgagggacagaaaggaaagagtaggagggttgtgatacgtgaaggagcatggggtgaaggagggaggagaggtagccaggagctcgttgggcctttagggccattagctgtggtcaagcatgcgtatgccctagagacataagaaaaggggaacttggacatttacagagttgatatttgaagtgttcatctctcacaggtaactgtcatggtccctgacacattgttctttgatattttattttaccaagtgatacatctgaattatgtgtgctgtgaatcactctgcaggaaagtgagcctagttaacagccaacacccaaatttcgacctcattttgtggacttttattcatgatcatgtaagtagtaacactcatgatctgattaatgttcatttctgtatgaaaaaaaaggtcaagataaagccaaccacttcaatactttaaatatacataactatgacttcaggatgcatttcccactgttgggcaccaggtcttgatttataaaataagggagttgattctcctgagtttctatgggtctacatggctaaagtgtgaaactgataaaatactattaattccaagtagattctaactttctctgaagcaataagacatactattattttagaaaaaaagagctttgaggatcttcagcttgcttaaaagaaacctccacacggagcattttctatagtttttctccatcctcctctagcacccctggaaatgtggccttcctcactatgtgctgggttattagagaagcttccccattaagttacagtcatgtatattggagatagaggagaggctcaaaagagaaagagagtttggagatgtaaatatgagacccatagtatcttccctgagcaaaaccaaagggaataataaatggctaaagaacagtgaaaataaagtaaaattgatgctgagttatataacactggaatgaagctaattcaatacctttaattaaaaaatagcatgcttggtttcacccagagtcagtcagaatttctccaggaaattaaatttaaaagcaagcaagagaacaaacaaaaacttctcaaaaatatatatatataattgtttgagataaaaatctatttattgtgtgtgtatgtatagttgaatatatataaatccttattttttcctctgtgacatacaggtgtagttttgtcaatagaaatgtcatgggaatgaaaaaaaatgtacgctttttggattgcttcttatttgtcaagatattagaggcaatttgcattttaaattgaagaataattggtttttattattgaatatgttatgaagctcaatgtattaatggtgtaaaagactcatcgtaactagcacaggattttttataagagacactttgatcttgggcaggacattttacctcttcgggtgtcatttatttcatctgtaaaataaagggctcagtctatgctaaatgaccaatacagtttcttctaactccaacattctgtaggttttggtaggaaatagaaaacctatgtgtgcaagcatgctcatgcctctgcttttaacactttcacaaaacaggcaaatctttacaaagttagacttcttttctgaaggagagagcatatttttatgcacaactgtcttcttgtttgttatgattactttctggggactgtggttcagaacaaagtccctggtctctgtaagatctccaatcttgaaataaaattatattcatgataaggttttcattgagccagaaatgtgaaacaatgcatttttaaaagatgttcaccaacaaggactaatttctatcctacttacttctcctccccagtactacccctcctcttccaagaaaagaatttggtttggctctcatttgcccaggaaatgctattaatcgcaatctcctattccctgataacattacttaattgaggttttattgagctataccattactcaaagcaacaaatacaaaagtgtgctttctgtcctctctctgtctctctgtctctctgtctctctctctctctctctctgtctccctccctctcttgcacttctgcatgccctatttctttcactcttgtcctcaaatgcaggactccatttaaaaggaaattactgggggaaataacagggaacagaggggtgattcagtccttggttgaccttacctagtctattgttttcaccaagtacagaaacacgacagtttctatgtgaactatagttgtaaaaatacaatgtgattaagaatattattgtagcagtctatcaaagaaccacagtatatgattttgctccacactatctatttttaagctataaaatcaattgcaacccttctcatttttcaaggtgttctttctttcttcattgactatgaagagacattttaataaattttaatgttttgaagccaggtagaatgtagaacttaaaatatttcttctaattctggctatgctaacttaaccttggaaatattaatggtttcttcaatgtatttctgaaaaaatcaacattttgattactgagttattaaattgccagggctttggcaatttcaaaatatctctgtctctgtctctttctccatctctctctctctctccttgtttcagtttgctactcaaaataaatattcaaagattacttattataattatctaattgaattatataattttatttctgaaagtaaaatgccaggtggaaattttatatatatcttacctaaaattattttttgtacatctataaaatgaatttttaacatgcatgtggtaaaaattcattttctttatatgtacatgtttatgaagaaatctagacaaatatacaccatataggtcttggtagtctttgggcagttagaattctttcttatccatttaaattttctttcttatccatttaaaatggtttcatgtaatgagcagatattgatgttgtaactgaaaaagaagtattaaactaaaattagtctttcatggatggaattcggcatggtgaaaatggtgataaaacagattgctatgctgaaagtctcatgaaattctttttcattacatgctaactcataaaactcataaaatttgagtgaaaaccaaaagaactctactctgatgaaggcaggactgctagctgtgccataataggttatctttcacatccatcaaaaatctattgatcatttaataactgctccttgattagggtggttcttccagcaagaatccaactctgtttgttttccctttttcctaattctgaggcatgaaactttataggagattttgattccatgcccaatcgtacatctcaccttacagcctctttattggtaatgaccttgctttcatcatgcttcgccatgccagtcagcccattctcatcctaaagtgcccaaagaaacataaactcctaacaagtcttctgtttctctgttctcctttcttccattcatttcacacacacccacccaatttatccttttaaaatgttactttaaatatatgactcatatgctgaaatatctttagggagtctctctgacatgaggaaaaaacccacaccctttagcctagaattcaaagctcttggacagctttgtctgctccaagtcccctaatacagcctctgctaaaccggaatagcccactcactaaatggccttgaacttcaacactgtcaagtgttggctcttcctgtttcttctgcctggaatgacttagcttgcggtttctaccagtctgacgcctatagggccaagtttagattccatacttcatatgctcttggcccactctacccctaagataactccccctttgctaaaatcctgccctaccttctcatttgggctgtgctttatgctgcttgacttttttggtgcacatggatgcttcctcccagctaaatggtaactgccttaaaactgagggttgtgttttatctttggtattttaaaattatctagaactatgcctcttcagtaatctcttaagaattgacatacagcaagtattttttaattaactgaaaccttaaccatcatgttttctaagcattttggaaaacatgcaaaagtatagcactcccatttttatttttagtaagtgtttaaagataagtaagtaatatttgagttaaccattatgaaaaccacaaaagtaagtttaccttttgctcaacttcctgtttctgaaaatgtccttttctcactgagtgtgtttagctagagcatttaaaaagtttgtccaaaacacacaatcatggcttgcctttagcagaaataatgtgtgttcctgcttctctttgtaaataattgaatttgcctctgcagttcaagaagatcacgatttctttttgtgtgtgaaactgacttgcttctgttttctccttatgtgcagcagactataaggcagaagaaaccctgtgcaatcgggatatggtgggtagggaggataatagaagagattgacatgacttccatagaagagttatttttaagtatagagaacgcctgtctatccccatgctgaaagagcctttagaaaatattaccaggattgaaaggcggtgggggcaattcccatcacctgggatagccgtgccagtctgcggagtgttgctgccacctgctgcatgcaaacagccatggaggggctgttgcctgggtcttgcagctgcaggacacccgaagtgtaagcgttcagttaatattctgtggccatgcatctgaaattgttatactttcagaacctgtgtggatcccaaagaaaaattaatcaaatctgatggcttcaggccatagaagtttctagatataagaatcattaactaagccctgaacaatacacagaagacagatttgccgtatagccactaaatgcatggctcaggtagcccaaccccaatgagaggcaagaattctactgaaagtaagtctgtagcactggaaaataaacgaccatttccatgtttctgagtttacagacttttttggaacaactgtttcactttaatacaataaaagataggagaagtctaaataccccaaagagggtattgttcttagagaattcaataaatgtatatttgaattggtttctacttaggtaaattcctcttaatatgaaaaatggaacgagatcatagaatcccttctccaggcttgtaatgtgtcctgatttaatagggacaccaacgtgcaaatcaggatcttcatagtgcatctccaggactatttttgctgctatgcttcataaaactttgatttactagaatttccaggggcaatgggaagagatgaagctacccagagcagttatgtctcttcctgaccttctataaaggactttgagttcccaggccttccctggaaaatcactgtcagtactacctgacccaatatccccagtgacctgaaactcatgggaagttgggaaggggtgataataaaggtttggggagcactggactaggcaagcagtaactacatctaaattctgcaagaaatcattagctgaggaatactgaataagtatggcaattatcatggcaagtatttgcagtggtggtatagggggtgatctggacgtccaggaagacagtcgcccttgtttatttacatgaaaacctctcttctcccatctaaatttaatctcctgaatggcaaaagcatttccttctgtcttagcatcgtccatattcaccacgagtccttgcataggagagattggtgtatacatgatgacaacctgacgaaaattatctccacctcacctgaaaagaattcccatctcaggattacaattggccttttcatttgtctttggtcttgctaggtggtacgtatattctagtaatgagattagggtcacaggatattttaatcattcatacggttgtatgaagacacacatgtttatttgtagttattctttgtccatcaaacttacagtagtcctcagtctaatgcttgttttcttaatgttggagggtgatgacagcctattttatctcaggctgaaaaactaatacaattaaatcagagaatcatagcagggaatagtcatcgtgttctacgaatagccagacatttttaccaaggggtcactttcctgaaacctgtttgcggttctctgtaaatagaagtaactaggcagatgtaataagcctaatagctcactgaggtgggaattctctgcctttggattctgattgttactgccttgctttggcttaggcatggataagctcttctgtggtgaacaaaaatggcctccagccaacctggtgggagacttccctatctgacctccaaccttccctcgtcttcccagacgaggggtagaaaagtagccctcactcctccactcccaggaaatgtgcatttccctgcaagaggagagacaataaaatttggtttgatagctgacactattccctgttacttttcagattttattaaaattaaatgtgttaattctttgttctttcaccccagggcaattctggaaagaaaacatatcttaagattgaacagaaaaactattatgaaaaacaccaagctcacatttgttaaatgactttgtgctcttgaaaaaaatgtataaaaagcacattgccaactgctctgcgtgatatcctttgtttggattttagacgcagcttgactgacacagagatcctgaataagagactctttggatactgaaaagtctcttaaataaggtgatacacaaatttcagagaacaatttcaacattgttctgtcgaacgttatactcagtcctgaaccacattactttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggtaagacttccagttgtcccttcttgtcggatgggccgctttaggggcggatggggcctctgttcatttaaaatgccttgtgactgctgctgaaattgatcaccactgctgaaattgatcaccaaaggacaaatcattactaagggtttcagttatgtatttaagcggcaggtataagagagatgctagaatctagaaatgattactaatgaacactaaaaataagaagggaatgggtcatttgtgccactgctctgaggcattttcacccatttcctttctaacaggatctccggagtaattggcaaattgtgtttcttggaaatgaaatgctctccaaatggtagccaaaacaactgcggaaaaattaaaaattacaaagccatcaacgctcagagatccttgtttaacttttttctctctcaagtactctctttcttttggatataacaagtatttctcatccaaatactaaggtctttgggagttgaaaacacgttgaattttaatgaggcatgtgtaggtatgaacctgggagacaaagtggaatccttatgacagtgggaacgagagcctaatgggcctatttaaaaagagaaggaagcaagattagttctgtattccacagtatgagagtatcatagtaagcctgagtgtcttaagaattaactgtgcttttcagatatagctatgaaaatattaaggagaatttctaaatcaaaagagatttggaatataatgctgtagataggatcagagccatattttcaggcaaaggatagctcacaggaagttacattaaactgtactaacctctgcctaccaaacttttgcatccacagaagtatgataattcccatttgtcaagtacttttacttttaagaggcttgtttcttctcagttgcttgtcatctttttatcttttccttttgtgagcttcagtggtacttgtcacaataatatatatcatttctgtaacaggattccatgttaattctaaaactgaggccaacactattgaaggcatgtcacagtctcaatgcttaacacattttaagtgtcctgtatcactcggtcagactgctgatgggaaagagactctacttatgtctagtatttcagaccatcgattagaggtgatactaagtggaacctctacctaaggttagatgaggtcctttcaatccttgtatattgaaagtgaaatttcttactctaatcaactagactgaatttgggagacagtttggaagttatgtggaaggaaaataaaataaaataagtaataataaagtttaaaataataagcataacataggtaatagttaacattaagtataggttacttagaagttatatgtaggctaagaaatttaagtagcccctcccagcattgctaacaagttgcagctgtgagcttatctcaaccttccaagcttcttgcctgcccccagacccccacatatttctgtaactcctgttttaccttaccccatctctgtctagcttcaagattgactggtcaagataactaaattgtaagttttctcagaattgtcacgggttaaataatttactgtctttgcctgaaacctgtatcctgccttgttttcccgcctcaaacgacatataagcaagcctgctttctttgtcagagtcagcagccattttgggcatgagtctgctgtgggcctggatgcctgaattaaataaagttctctttggtctctaaaggtctctttgtcttccttggctggagttttactgttatacttatgaggtttatagaaagaccacagactctgggcaactgaattcattcttttactggaggtgtgactttttttgttttgtttcgtttttcgtttttttgagatggagtctcactctgttgccaggctggagtgcagtggcatgatttcggctcactgtaatctccgcctcccaggttcaagcgattctcctgcttcagcctcccaagtagctgggactacaggcgtgcaccaccacgcccagctaatttttgtatttttagtagagacggggttttgccgtgttggccaggatggtctggttctcttgacctcatgatctgcccacctcagcctcccaaagtgctgggattacaggcgtgagccactgcgccaggcctggaggtgtgactttgagcatactgtttcatctctctgtggcccagtttcttcctcataaaaaggggttaacaacatcacctatggcgtgtgagggggattaaacaagataagatatgaaaggcccttgtaaacatgtatttttcaaagaaattgctatacacatatcatttatttttgcagtttcagaaagcatcacgtgtgtattatattcagctgtcgttttataacccaaaaagccaattatattaaatgtaagaagaatcgtcatactaagtttgctggtgtgcttcaattttcaaataggcttaattttattcacaggtagtctgaaaccttcaattatattttggtcagaccaacacatagataaatatttagaagtcagtaattgcctctagcttctctacgtaaatgcctcctcatttatattgtctcatgcatctctatctgagtgagacacaagctctactctattcctaaagcagccagggagaaatttcctcagttgctcccctcaccttactgaagtgactagggtttttaattaagcgtcattctatgtgaattatttaaactcatggctcatgttctttcttttcaggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacggtaagcataactggtagagggatgtgctttcattcagctctctctcattcaacaaatgtacattttaagaaaagcaaggttaggcttggtgctcagcatacaaaggttgagcagaaagagctactgtctgataagagagacaggaagtgaccacagcatttaagtaaataaatgtaaacttgcaacagtgataagtgtcgataataaatactgtaacagtcttgtgaaggagcacatcacagaggccattgaaattgtccttgagaaattaacaccatagcttaagtctaaagaatgagtagacactaccacaatttaggaggtggggctgaggcagagtgggattgtgagtaatcccagagagagaaaagagcttgcatgaagctctttggagtgtttgaagaaatgggaaaatgccagtgggacagcaatacagcaattaaaggataaggcaggtaaggaccagatcatgttggacctggtcagcttcccttttaaaaggtttctattttgatctcagaaccataagaagacatggaagtatttccaacaaaaggatggcatgacatttataggctgactgtatttgtgttgtttaaaaaaaaaagtcatactgactttcatgtgaaaatgaggtgaagatggacaagaaggagaaggtagagacaactcaggagaccacctcagtagcccagaaaagagagagtggtagttcaggtagatatagaaggaaaatggcaaattttgttcattgggcataaaacagatatgatcatagagagaatataagacaagggcagtatgaaggaaggagagaaagaagttaaaggtgacatctgggtgtctggcatgcacacctgaatggtggtgctattcactgtgatggaaggtaaaggaaggtttgtgggtgaatttatgaaagtgattctgggtatacaatatttagtctagggcaggtaaagggacaaaggaagctgctaactatgaagcattcacaccaaacatactttggaggcctgcatttagaagtgggaatcctagatttaagttctagctcctttctgaatagaaataaaatttgacttggggcctgtggtgtaaattctctgagcccatttggaaaatgattataataatgcctgccctaaattacctggtcctaaagtaaatgattttcatttctgctaatggaaaacaatgaaagtgaaagccaacagatgcaaaatgcactggcagtggactggttctaactcagggcaaagtggcctggtaatataagaaaaaaaaataactcgtgaaggtcatattaaagggggcatagagctgtccagaacaagcaacaggtatggatttatagcctcctctccatgtcttataacttacttgctttaaaaatatgctgttggaacagtccacctataggccaaggtcccatcaactactatcttataatgcccaattcccttgctgttttccaggaggaaaacacaccacacacacacacacacagacacatcacacacacacacacacacacacacacacttcagttcaattaaggatggagtggagtgggattgaagtaaagagaaatggaagacctatatagaaaactgtttagctatacatagtttgattcaggtagcctgtatttggatattggctctatcatttaccatacgtttcatcattcccaagttgtttcaagtttcttacataacaaatatggataattatagtgctttctttacaggtatcactagcttggtgattaaatgagataatctgtgtaatgcacttaaacatatagttcctgctaaaggataagagtttggtaaatggtagttttcaattaagaatagtaataattatattgagcaaattctatttctcagttccaattaaatatgagccctgctccttctttttatatattgacctcatttggaacccagtaagacatttgccatgtaatgttagtacaagtacacattgaccttggtttcatacatagttttttttgtacattctgcctgaaccagtaaacaatactattgcctcacggaggactcagtgtttccttcattgagacttggcaacatggactgatgtaccttataggaaatagaataagtgatgccacaaaatgaagacagcaatggagaacagatagtatattatccagaaaggaggatgatgttgcctttaaagaaatgtatttcttaaaataaagagaaccaagggagttaagcttgtagctactaaaaactgcaggtcactggagaggcagaaaccgtatctatactttttgcggttggaaaatttccggtcttctgaatgtaactttgctgctgtcatctggatcagatgaaaagcaatggcctcagtgttagagaaatggttctggtattgtgattttgggtacaaagggagtaaaatagaaaagagcaaaacagaagggggaaacatccttcaccacagagtgaccacaaatgtaagcctggtacggagctacagagtaggcagctgactaaagggaggcagttgccatctgagagctctgtcaagttcacaaccaatagcatattttctttctaccctttactgttttgatcttctcttgcttcttctcctctcacttgtacagttttcttcttatgcccctgtgcaatctttaagtttacaagctagttgggtaagcaaaacacacctgaagtgcaaacacttatatagtacataaacaaatgcaaattgaagtggtgcataagaacctaatttgaaaatgctgagggacttgaagtgtttgagttgatcatctcttcctgtttcttttctgttgctgtttgagtcattctctcttgtctgctcacaacacagtgtgtgtctaaatcctgttcccatgttccccaagggcctagctgtgaaaggattctgttctcttttcacaatattttgtctctgtgtgtgtcttagtgctctgagattgtggacaagagtggaaatataataaacagtgtgaggtttgcctctttttcgctttcacttgacagagtttcctcctaggttaggagattttcagtcactccaagaaatgcagttctctgagttaagccttggattgtcataatctagatttcattcatttgaatgctactggatcccataatgcttcagattgtaagattttggtgcattttaaaatttgtagttattaagatcagttataagagtataacatggctttaatttactagttcacagtaaatgccttggtgggctgttaatgttattggaagcagtagtagcagtgaatgcggttggagaagtcatggtcctggaagtagtagtaatagtagcaataaaattttgatactacaatgttgataagcttggtctaaaacatgttgttatcctgtctagtttgtattgagcctgaatgctggctcttcttaaattcctgtatttagtctttatccaacaagtgtttttgagtgcttacagtgctagacactgggcactaggcacagagtaggcatatatgcatgactgtgtcttcatgaatcacaaagttcaataggaagaagttgacattcatcaaataagcaaacaaatatcaaattgcaacagtgagaagtgcttcagaagtgaggaagtagtgtatgagagggtataataggaaaatcagaaaagactttctttactttgtcctttcctttcccttcccccttattttcatttccctctcttctcccctcccctctcttcccctcccctcccctctcctttcctttcctttggaagcgctgcttcaactggagttaaccaagtgaacacagagctttacaaagaacaggacatgcaaaggttctatgggggaaggaagttataacaactgggtaggcaggggagattttaaaaggtattatggctggagcagagggattacaggtgaggcagttgacgataaggttagaaagattgattagtccatttaaggagttttgtctttatcctaagagctgtgggaactaattaaaaggtggttgttttgtttgattttttttgttttgcatttcaaaaatgcatctttgtggttcgagtgtagagaatgaattggagaaggcagagacgatagtgtggatcagttagaagacaacagcagaaagctacatgagagatgctggtaccattaagtacagtggcaatgaactagaaatagaagaatgtttagattagaaacttgtgtaggagattctccccacaggatcagtggtggattgcctacgtgaaggaaggaataaaaagcagcgtcaaggatgatgctttaatttctaatatgtgacacagaaaaaataggggaacattgtattagggaacactggaagatgatcagatcatacagaaattattttgcatttaatcttatagatgttgagttaggcatgaagttgtgacatacagaagacgttaggtaaactggatatacaatttcagatctaggagagaggtttaagctgaagatacagagtcatctgagtgtgagtgttaactaaaattctgggagtgaaagaaatcctctaggaagagaaaatcaagcaagaaaagccatgtggcacttcagcagagtccatggtgacggatggagaaaggtgagtcttcagaggataatgaagagcaattaaagaggcaaaagtagaatcaggagtgaattgggtcacaaaaacctggaaacatattacataaaaggaatagccatcaattataaagtttctaagaagataaaatagttattcgaatgtattttaaaacatgaagttttttttatcacctaacaggaactgtttgatggcattatggaatggaagtcaggctggagggagaagaggaatgagtgggaggcaaggaaatggggacagcacattgatatgactttcaagaaatctgccagtagtaataggaagagtagatagaggtgttcaaatgcggaattctgttgatactacagtagtgatggtggtggtggtttcaattaataagaaacacttgactgtgcttcaaagttaatgggcaggatctagttgaaaaagggtagttaaatacacagtatggaagataaaataataaaccaaggtttctaagaaaatggggacaatgatactcacaacacaagtaggactaccccgatattgaaaaaaaaagaacagtttttttttattgtaacaggtgggagggaaaataagatgagtgcatatgatgagggaggtgctgtcttctatttctctaaaataggaaacaaaaccatcttcagctagagagaggaaggaagcttcagaaaagaagattgaggaaggtttgaaacagctgctatggatagaagggaaatggattcactaagttaacacatttggatttttggtctgtgttgaacatccatttgggtatggtatgaaatggtagtgaaaacaattcgcacaaggctttctccagcagtgattggctgcttgagtctgggcattaaaaagtacatagtgccacatttggattcctttttagattgttgccaaaaggaaaacaaaaaggcaaaggatttggggtataagcaaaaatattattgacataatgcactatagaactttagcttgataataagagatgcaaagaaaaaataaagctggtgatttggaaaaaagtagagtgattaactcattaaaagaccaatgaggttggagaacagttgaaatgaaactggttgcacaaactggaagaagagatgtttgtaggtctgaatttgtgattttgtagatgagctattttacatgataacaagatccaagatgtgattgtgagagtagatggctaaaatgaagtggagacaattaatgaagatgacagtgggaagaactgagagtccaggtattggagaagtcatctgcatggtcactgaaagcacctaggttatgtcaggtttggggctgcaaaatattgcagtctacataaaaacattttcaaagaaaaacggagtgtgattgggagattacagcagaagttgacaaactttttctctgaagggtcatgctaagctttgaatatttgtccccttcaaaatcattttgaaatttattgtcattgtaacagtattaagacatgggaccttctttttcttcaaattttaagttcaggggtacatgtgcaggatgtgcaggtttgttatataggtaaatgtgtgccatggtagtttgctgcacagatcattccatcacccaggtattaagcccagcatccattagctattcttcctgatgctctccttcaccccaccacaccctccgacaggccccagtgtgtattgttccccctcatgggtcagaatgatttataacagaatgatttatattcctttgagtatataccagtaacgggattgctgggtcaaatggtatttctgcctttaggtctttgacgaatggccacactgtcttccacaatggctgaactaatttacactcccaccaacagtgtaaaagcattcctttttctcagcaacttcaccagcatctgttctttcttgactttttaataatagccattctgagtggtgcaagatgatatctccttgtagttttgatttgcatttctctaattatcagtgatgttgagctttttttcatatttgttggctgcatatatgtcttcttttgagaagtgtctattcatgtcctgtgcccactttttaatgagtttgttttttttcttgtaaatttgtttaagttcctttgtagacactggatattagaccccaggccctttaagaggtgatataagggctccactctcctggaaaagatttgtggcaatataaaaatgtgtgtttgtccccctcttttctctctgtggctcttctgctcttctgccatgtggggagcagcattcctccctccgaggatgcagcattcaaagtgccatcttgaaagaggacaggacactgggctctaaccagacaccaaacctgccgatgttttgatcttggactttccagcctcaagaactgagataaacaaatatgttttttaataagttacctaatctcagatattcttttgcagcatcacaaaacagactgaaatagtccaaatactaaatattttaggctttgtggtccatgtagtctctgtcacaactactcaactctaccactgttgcataaaaagcatcacagagaatatgtaaatgaatgggcctgactgtgttctaattcaactttatttacaaaaataggcaacaagccagatttggcccacaggccaaggtttatgacctctgagttagaggataatagcagtgaatcaaggaagaaagggattgttttgtttttcttaaaatatgttgctcataactgacaatactggtactggagatggttttaggtgattcatgaaacaactataaaagctttaattgtggaaaactctaaacaatatacaaaaaatacatagaataattatgaaaattatatagaataatttcccacatactgaacatacaacttcaacaattatcaactcataggcaatctcattttatttaaacccttatcaactgctgccttccaagattactttggagaaaatgcaagacttcttgtttattttagtatgaatctttaaaagataaagatgtcattaaaaaaaagccataatctaccaccaaaactaaaaaaaaattagtatttaatattattcaatatcccatcagcctgatgttatattttgtttttttttttaaattaggatgcagataaactagatatattgtgattatttggaaattcccttttaatctgaaagctatattacatttgttatttttcctttgcgatatatttgttgaataaatttgatgatttgtccagcctggattttgctcttatagtcccatagtatctctatgttttcaccttatagttagacttataaactctaagttatcttatattcttgacagagacttgataacatttaggttttcttttttctttttttttttttttggcaagactacgtgatagatgatgcatagttatatgagaggcacataattctggttacatgatattaagagccactggtgagccttgcctacatccattaaatcattatgatttgccgaatagaaatattctatcattccctaatttattagcttaagtatttctataaagagaaacttcctctcatcaacttattatttatttgatgtatagtttgtataagaaaagcagaatagatacttgattctttccctttaatcaccagttttaaaaatgagttggttaactagtatttttagaaagtgacccgtaagtattttatgttaagtatcatgaatttatatgaacttaaacatactgatgaatttcaattcattacggttattatccttattttactgaaaatttcccatatataaaacctattaatcctttgttatataagttgcaaatattttcccagtttgtcatttattcttactttcttatattgtttgcaatgcagcatgtttcttatttttattaaataaaatctattactcttttcccttattggtcctgattttaagttttggtcaagaaaagttttcttcatttccaaattatataagaattcactcataatttctgatacttgcatgctttcttttatgagcatttaaatttgtaacattaggtttctggtgcaaaataaaaacacctaaatttacatttttatatatctctaatgccttcttctatattttctactttttttcccttctgtgattcaattaggtattcacctgtcttccaatcatgaactctatctctatgatgtccaataagtttttaccccatcaaattagttcttaatttctgatattgtatttttaagttatttgatcacatttgatagatttttaatttttgataaatttgtccaccttttgatctacttcctccatttcttctctgttttcttgactatatgaaaaagagttattttaaatctttgttggataactccaaagtcagaagcatttgtttgtctgttcctatgtctatttttctcttattttctttttttgcaacttgctccaccgtatctcctctaaaccactctgtattactaaatatactgcatctatatcaaactataaagtacacgtatataataatatatgtattaaactcaacagttcagtgttaaattaaggatttaaagcagcagtacccaactttttgacactagggaccggcatggaagacaacttttccatagactgtggtggagggggatggtttggggatgattcaagcctattacatttattgtgcactttatttgtattattattacattgtaatatataatgaaataattatacaactcaccataatgtagaatcagtgggagccctgagcttgtcttcctgcaactagatggtcccatctgggggtgatgggaaacagcaacagatcatcaggcattagattctcataaggagcacacaacctagatccctcaaatgtgtaattcacaatagagttcgcactcctatgaaaatctaatgcagccactgatttggcaggacacagatctcagatggtaatgcaagtgatggggagtagctgtaaatacagatgaagcttttcttactcacacactgctcacctcctgctgtgtggccccattccttaacaggccacggacaagtaccagtccatggtccaggggctaagaacccctgatttaaagaatttcatgttctttaacaaaattaagagaaaagaaaagaaaaataaatgtatgtatagtttttatttactcacatatgaagactacatatataatttttcatatttactcacgtatttaccattttttgtgctctttattttatcccatgaattggagttactgtttgttgtcatttcttttcagcctgaaggactttagtatttcgtgtaagacaaatctacttgcaatgaattctttcagattttttcatttttaattttaaaggataatttcaatggatatagaattcagagtggattgtttctctttcttttagcattttgaatatatctttcgatcgccattatttctgattaaaatgagccactagttatattattagtctgctgaatgggatgagcttttgtttttgtttgtttggttggttggtttttgctcctttcaattgctacttttataatttagtctttctttttggcttccagaagtttgattatgatgtgtcttttggctttcagaagtttgattatgggtgtctctttgtgtttgtcctattcaggtttttttaaagttcttggatgtgtagattaattttaagaaagtttttaaataatcaaatatgtgaagtttttggccattttttcttcaaatatttgatccatccccttactctttcacttctttttctactactcctgtttcatgtatgttaccatacttgatactgtcctatatggctctgaagctgttttcatttctttcaatcctttttctcccttgagattagataatttatattgaacaatgttcaaatacactgattctttcttcagccatctcaaatttgctattgagaacatctagtaaatttcttatttttgctactgacatttcaactctaaaatatacatttgcttcattttatagctttctatttctctactaacatttcctatttattgagtcattgtcatattttgctttaatactttgaatagactaataacaacttcttttttttttattatactttaagttttagggtacatgtgcacattgtgcaggttagttacatatgtatacatgtgccgtgctggtgcgccgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaaagatgatttccaatttcatccatgtccctacaaaggacgtgaactcatcattttttatggctgcatagtattccacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtcccatatttcttggaggctttgctcatttctttttattcttttttctctaaacttcccttctcgcttcatttcattcatttcatcttccattgctgataccctttcttccagttgatcacattggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgtgttcctttggaggaggagaggcgctctgcgttttagagtttccagtttttctgttctgttttttccccatctttgtggttttatctactttcggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgacttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcacttcccaggtgaggcaatgcctcgccctgcttcggctcccgcacggtgcgcgcacccactggcctgcgcccactgtctggcgctccctagtgagatgaacccagtacctcagatggaaatgcagaaatcaccggtcttctgcgtcgctcacgttgggagctgtagaccggagctgttcctattcggccatcttggctcctccccgaataacaacttctttgaagtctcttaaattcaacacctgggtccacccagattcagctgcaattaccttttttccttattatgggtcacacatccctgattcctccatgtctcataattttgtgttgaaaactggacattaaaaaatatatatatatttatagacagactatagaatatatatatatgttgcaactctatattatgtcttatttaggttcattttgtttcattttagtaacttatctgtgcttaaattgaatgtctcctttgcaatgcaaggccattgatctctcttctcagatttttatactaatagttattttttaatttggcttgcaagaagttgcccctgcattggcaaagccactttattggtccagccatgattttggcaaaagttatgctcaaatacttaaatccattaggcttcctctctttatgcatagatttgtgtgtcaatcagggagtgcattcaaagttgcagccagttgtccagacttcctgggcttttacattttgctacgctcttttgggtctccctgactcagtgtgtagtttcctagtcagggtataatctgtgaagtctttatcttagccattccatgactctagtttccaggatctccatgttaaaggtctttctggtctagcactgtctttgttttgtgctgctctaacagaataccacagactgatacattagaaaggatagacatttatcttctcacagttctggaggttgaaaatgtccaagatcaagccattgacatctggtgagggcctgcttgctaaatcctctggaggggagaaatgccatgtcctcacatggtggaaggcagaagggcaagagacaaaaggggaattaactcgcccttttataatggcattaatgccactcatgaaagctctgtcctatcacctcccaaaggttccaccttctaatactgacacaatggcaaccaaatttcaacatgcatttcagaggggagaagcattcaaatcatagcagccactcactccagatgggaatacaaacccaaactaaccaagcttcaggttttaggcacctacgaagtttgcttctgttatgggaaaaggtgaaaggtttctatccctagacctaatttaagtctgcccattgtggaaaaaaagctgctggtttttgcaaccagctccatgtggctaaaactacatttcttaatgaccaggttggagaagggaatggatggagctgaggcaaaaagattgaagtctcctgctgtttttactaaagctctagtgatttttcaataagaaatgctttgcaatttaatgactacctttagtcaatttccacggccctaaaattgttgttgtttttttaaacacatttccccagttttgtacttgtctgtttttactgacctcctcatgtccccataaccagaagtctctcattcctacaccccatattttgatatttatattgtatctttatttaaaaacatatattcatcactattccctttgttgtaacaattatatattcttagtgctaaaggtaaatagataatcaacatttaccactaacctttatgtaaatgcatctccagtttgaaatgtattctattggagaatcctcaggaaaggctcatagcagcaatattctctgagttcttgtgtaactctaacatctttctgtagtctttattaaaaaagactttattaaaaaagaatataaaatctttggctcacattttctttccctgagtatattaactatgttactctattgttttctggcagaggactgctatcaaaaagctaataacaatcagattttctttccccatgtttgactttgctcgatacttttatatgaacatgcttaaagttgtccattctgggtctattttcctattttgcagtataatcgtttaatgtgcagtttctagtcattttaaattttattatatttttcttgaattatagtttttaatatttgttctgttccattgctttcatcttttttctttaatgtcttttattgtacatatatttttatcttctttgcatatcatttcctttgaatctcttttatcaacttttttctttttttataattacatattgctttatttatttcaaaatttccctcattctattttgaaaatgaacttcaatgaattaacttttgtgtttctgtgtttctggtttcattctaattttgtcttagtttctggagtgatttttaaaaatttattatttctaaccctttctcgaatttcgttacctatgttttgtaagcttttttcttccactggactcattgggaactttccaaaattgtgcacaatttcatcattttatttcttttagctcattttgaataatttggctatagtttttatttactttgttgtcgtgtcttgataatatgctctcattgttgtaggaatgttattttgttctctattctttttttgcttctggtatctttataggttattctatctcattccctttctatcactcatgcttaagttaaatgcattcttatcacagaggagtgggccagcctagcttttctagagtgttcagtatccctaaagccgcctcttctgttattttcaaggtaagtaatttaccattgtactttctgagtgtatttcctttgcttctatccctcacttttacctaaattgcctatttgatttctcttagtggacctgtcctgtcttattggattctatgtccagcagttttttctccccatggcatgtgtcctgagaagtcctttctgctccagcactgacaacctttttcttatttttcttgaagacactggtgatttggtgcccgcaaactctcttctccatttgagctactattcttggattaatctacctgtctttccagtgattacctgttactaggcagagggaggtggtatgggttctctagttctaagatccatcagaagcccagttgatcttcctctgtttctgcacagttactgatagcacagtggtttagtggatttttccccaccaattaagagggatgtgttgttatttagtgttcgtgtagatatgatctatgtatttttagttttgttaccctatttatcttctttgtttttatagagggtttcaggtatattcaaaaagtaatgccacttatactgccagcttcccagattctggacaaaatttacaaaaatgtaatacttatgtatttgactgatgttcattaaaatataactaacatatttggattgcatggacttcagagatattcagtatattttaaataaatatatataagtaaaacaattacaataatttaagaataaaattagatagtagtaatggtcttatgcaaatatggcaaaaaatgatgatagtagagatggtatagaaacaactccatttggaagtgctgtgatagctaagtgattttttttctccttaagggacaggggtcttttttttcaattatgggcttggagtactatttggaaacagcagtggagagcaaggaaagcactgatcccacctccagaacttgaggaattagagtgcaagaaaatatataaccactatttggaaatgctgtggggaagatgtaccctaatgggaagatctggttttaattaggaaaaggaggaggaaagagttattggtaaagaagatagatgatattgataagagattaaaatataacaaagatctaaaggctagatataaaatttataaacagaaatatgccattaaaatgtatactgttatatagcatatatttatatatatatttatatatataatttttagccctaaattggtgctttaatcttcagtttccttttccttgatcagaaagactataaaacttcataacctagcctttgcctttttattttgatggactaatactgtataaaagttataccgttttataacatatatatatatattcacaatgttagtagcaataagaatgttcatactcaatgatccattaattatacctcagagaatttatcttaagtagctgaatggtcagaagaaagctattagcatgaggatgatccttgctatatagcatgtaatggtttaaaataaagtaaaaagtccaaactgaaagagcataatgattcaataattggaaatgactaaatgaatgatgattagtatatatgataaaatgacatgaagcccccataaatttaaatcacctgtagttcaagaatcacacaaaacattctaaagtaacaacatatataacattcattggtaaacaggattgcagactatgagaatacatgcatgtatgcaaacaagatttgaatatagaaaaaagaatataagatttttaggatatttagatggtagagttgcctttatttgtaaacttcttttgatgctatagtttagtcacaaatttatatgtatgtatataaaactttcccaataggagagactacaaaatggatatttatcttctattaccttaaaaatgaaaataattaacactgcttcctcaaagtttccttatatatgtttgtgtcattcctttgtgggaggaatgtttataaactctgggaagactgttagatatgaagactgtaaaaagaacagaattttagggcaggaaaactattatgtatgatactataactgtggacacatgtcattatacatttgtccaaacccatagaatgtgcaaaattaagagtaaaccctaatgtaaactatgaactttgggtgataatgaagtgccagtgtgggttcgttaattgtaacaaatgtaccgctgtggaacaggatgtccacagtgggggaggctgtgggtgggtagaggtagtagatatactgggaactttgtactttctgctcaattttgctgtgaacctaaaactactccaaaaaataaagtccaacaaaataaaaagacagttaaggctaggttatgaagttttgtattctatctgatcaaggaaatggaacctgaagattaaagcaccaatttggggccaaagcagaacatgccaaatcatgagtttgattctgttggggtcatttccttgtaatttttcagtgtttagcaacaattctgtgctcctcagtgactctgtttagccacttatacaatgagggctatcgtgggagtttgcctctctttttcataggtgtaccctgaggacagatgaatccctatactaaaactgtttttgtctctttgataaaaagcactttacaaaccaatcagagattcacatattttctaccttatgttttgttacagttacagcagatgaatggaacagcaaccatacgatagaaatagagataaatcagactctggaaataccatgctttcaaaatagctcctcaaaaatttcatctgagttcacctatgcatggtcggtggtaagtgttgcccttttcagtgaataacctcaatggtctttaaacattaacgaagtaaaatgaataagcagtaataatagggaaggaagcatacaaataacaggcaggcattatgccagtggtgggaagaggggtagggaaggaaggagaggtcactcagattccttctcacaggcaagcctctgagtctatgaatgcagtgaattaatttataaatttgcttctaaagattgatttttacttctatctatataccaaaccatggttacagaaagaacaaagtgtgatagtgccctagaaaggagccatattcagcagaagcccctactcacagatacttgtttcacaaacaacatatgcagagctacagactcctttctccaaaaacacttattactacatcctgggaaatatccaacattgggttagatagggaagcacagactctaatgcttgtgaaatataagcagcaaatgtatatgagacgagcaggccttgtataagaaacagtcactgcccagctcttgtaatgccacagggggctgcaggcctatagttgcatgccttctcattaaaaaacaaaaaacagacaaacaaacaaaagccagaaatctggatttttatgaaaaattttccaattttaaaaatgatgtgtagagcaaaaatgaatagtggtctattattttgatgttagagcaaaaataagtactggtctattattttgctaagacactgtaaaatataactctaattataaatttaaaaaatttcactgaggattcactttggcagttatggtgggccaactattaagttgcttaacatgcttaacatgtcctgtgatgactaaattctcccactacttttctctccttgaaatactgcagagttcatctatacagatctttatctaatcggatttatgatttaatttggcctgtcccttaacaaaactgcatcagttatctactttgtctgcctttgttattttatccttagtctacattgttctgcctaatgcatcagtttatttttaaaatctaaatttaatcttaaaaactaaaattgagctttttctcataacacgtaaacaaaatcaacatgaggataataataaatatgaaagaattgtgtcattataactttaatgttagtcaaccaaatggcagccagctactaaccagtgtatacagtaaacccctaaaactgttaaaaacaaatgacaacaaagagacaaacacaattatagaggtgatcataaacatgatttcaagaatcacataatagggcattcatttagatgatacagaatatgattactgtatgttaatttttatatttttgtcaaaatgaaaacaaaggatttaaaaattcttatgaaactcacagattctcatgaatgtaacagctggcacaatttggaaaatactgtgattcagatggctgattattcatattacaagctacctagatttttgtggacagtcttggaaactagaccctatatataaaaacatttccttgggtttgtgccaaacccaaaataattgacttgtactaaaaactttaaatacaacctactgataatttttcactgtctaggtatttttcagatagtaaataataaaaagaattatattttaaaataactttcccaaatggttgtaaaacctacagtatctctttgtcatctgtcacaaaactcgtctgcccttttataggatttgctttccaaaaagtaagtcttcctggacagtaggcctatcattaggatgagtataagtccattgttcttaataaacatgatgcaacatagttctgagaaaaaggttaattaagtgagataatttcaggaggacagaaatgtactatactaaaccttttagtaatgaaatgcatagcttgcttaatattttccaccaacagagcagaaagttcctatcccagttatcacaaattcattaacaatggcaactggtttaataaagccttactgtagatatttttactgtagtgttcttatcttgtctcatgggtatgtaatctgtttttctaagcaaatgtaaagccttcagtatgtgtcttttatgtgagtctgagcttctcctggacaaaaagttgtatctctcatttctttttttttccaaagtataaattcatattttgtaggaaatgtagtttacaaaacagtatcaatcgctacccccaatccagatgacccactttcctccgaagggggacgtttaggtcctattccactgggcaagggtaaaatgattcagtagtcttccaggttaacagtaaattcttctcccaaggctggggccgtcaaggcacagtctgtatgaggctcaccctgtctgaccctaggctggggctgcttgctcggtaggcaggaattggggtgggggtgggggctcagggaagggtctgcaccctgagacttctgcttacaggagggtgctgggaaaaccctgccttgggttggggaatcccctctctcccacctttggggaatagggtggggagggggtaagtgggaccctgctgcctggagggctcaggtctgagcagcagggagcccttagtgcccactccagcagacctattgggaatttactacctgaagacaaattataggtctagggtcttctttgtgattttgggggagtcgaggcattggggggtgagaggtatggtctaaggtcacagtctgggagaggagtccttgggatcaaaggttgtgcagaagcaccttccccacctcctgcctcatgagataaggttgccaggattccattatcatggtgaatttctctgggctcgtgggttaggggtcacagtggagccaccaaggtagaaatcacaaatgggacgcatgtgtgttaactgacagtggcctggccagacatcagggggcactagatccttggcaagaaagctaagggatcaacaggtgagatgtgagacaccaggcgcatggcagctcacacgtacatggcccgggacatgacaaagcatttgccctggtaggaatcagaggggctgctgtaggacagagcatcatagatggggttgatcttgtccagatactcttcctcctcctccccctcctcatcctctagatccagggaaacgtcttccaaagcaggtggccctggaggcaccgggatgggggaccccaggcttgtggctccagggtgcaagggtcctgaccgctcttccaaggtgggcagctcatggtatcgaggcatttcctgctcagtgcatgaggcgccagcgtcaaagtagggggtcttgagtgggctgtgctctgaggccaccagagtgaaaagctgggagggcatctcctgctcctccagcttctcttttggggtcagcggcttgtaggagggaggtccctccaggctgtggggtaggaggtaggtcaagtggagactaagacccgggcatccctctgaatccagggttacagcacatgctgttccctctacctgggtcccccttttccctgcccccttttcttgcctggagtaagagtttttttgttttgttttggtttttggtttttggttttttttttttattgctcatttcaaaaatctccagcatctagtatagagtctagagcataggtactcataaatacttaataaatacttgaattaatttatttctatttgtcccctttccccacagtcttattcattgttctcatattaaattaatgatcactaaattcatgctgtttgattgtttaatgagtggcagctcattaagtatcaaagacttgacaactgatgagtcaccgtttatcaagtagcttcctttaaagaaactaagaaggccatgtagacattacctttggattctgccaggacatttagagtaaatgaatgccagagagtgcatctaaggtcacacagtgagagggtgaatcttaaacatccactagaacctcaagccatgctgccactttaaagaatgcaccatgataccaacaacttgaagaatctttctaaagaaacctttcttcaaagggaacatggtgttggcaaatgtgctgattaaaatcctatggtacatttcctttcaaaatgtcaaaatctatttgctcctctcatttacatctatgccccacaatattgatggctgtaggattcagccagtctattaaaccatctaatgtccttataaagtagattacatagggtggttatagtctcccttaaatgagaacaaacttcctaaataagtggagggaacaaactgcctgacagttcataaaccacaccctgggctcatggttagaacatcccacagcaaggaagtaaaggaacagaatggaaaaatccccacattcatgcaagtgcagaaacccatgattagtgtctttgggctgacctatgctcatcataatggtaaaaaacacacccatgagtagagatttaagatgttaatgagacatgccatgtatctacccgcacgtacaacaatagcacatgcacatcgggaggaccaccccgaacatgcttaatagcaacacaccttcccaacccttcatgaataatcatatgagactctcataaagggagtttccctagtgtcagtcagcatcatctcacctttgagtagcccgctgtgatcagcggtgagtgtacttttgctttgcagtaagctctcttacctcttttcattttgaacttgctctcaaattcttttgtgtggtaaagtcaaaaacaaactggtgccactggcaacacttatattagggaataaactacaactcttagtatcataattgttacatgtctgcaaaggacacaaatattccagccaatccatatttttggtctttaatctcttcttaaactaagaataagaatcataagataagcctattgttcttacaaacatatataatctctttagaaagagattacaacatagaaatgatgaaggtgagctcaggagagcagaaacttcctatactgaactctgggaagtttcaaaggccttctgccccaagtgactcatgaaaccctggaaacaatttacaaactaaaattatctaagtcactgaaaaacaaaagtgatgtcttcctgtttgtggaattttataaaagctaattaattcaattatgaccctcataggaaaggttataattgggattctgtctcataaaataaactcttatgccacatctgcctgatctcatgccaaggctgtgttaagtgtgttaatgggacagactctgcattttgggaagttacatcgcaggactgggaatacactgaggtagacgggcatcaggtgcaaatggacagtgtatctaacattcatccagcatgaggggtaactaagtaaacacaaagggttaactctctaatggaaactaataatctacgtgaatggaggagtaatatataagaaatcctagaatatgtgtatttagatgggatgcagttggaagctgaaagataagtggtattttttcccatcttatgcattgggacataagcatatagtcatgagggaagttctgcaggcttattctggaagcttctaaatatactctaatattctgttttcatagcaaactatcatccttgtttcccacagcatgaatttcagttcagtccaataaacatatatgaatctgttttgagcactaagtcctgcagggatacaaaactatattggacatatttcctaccatgacatacacctttaataaaaatgttaaaaacggcagcatggggaaaatagttcaattccgactagatgaacctgggaaagcttcttagaaaaggttatatctgagctggataattaaatagttggctagcaaaagacagacatatactacaccaagaccctgggacctttaagtacaaattggtagtgcagacgggaaaatgcataagagggaatatttgttcccaaagtcagtgaaaataaagaaattcacgatttttctctttaaaatcatgaagagaaggacaagaatatttccaattcaaacaattcaatattagtgacaaaagcacataactatagattctcatctatcttaaaatttttatctataaatatatcttcaacatgctcttatttaatatttgtgctatttatgttaaaaggtaagtggtactatagacaatgtttgttatgcttatggatgcctcactattcagaaaacaaaactgtaacctcttacctgatggcagctgattctaattgtctttaataaaaaaatgaagtgccaaccaaactacaaagtgttgataaccaacagcaatggttagaaatatattgttctggtgctctagaaaatggatgtggggagctttgcaagcagcttgctttgacagcactgactggatggagaataaatggaggaaatgtgaagataagaaacagtttggagaaaaaaggagtagcaatcaatacagttaacagcagttattgaatgagctctgtacactcagcacctgccatgtgctgtggtcagtgcagccagctctgacatggagctggtttcaaggagctcaggatagctcagagatgaaatatcatcactaaatcaaggaggttgaacatcccaagtctgaaaacctgaaattcaaaatgctccaaaatctgaaacttttttagcgcacacatgatgctcaaaagaaatgttcaatggatcatttcagatttcagattttcagatttaagatgttcaactggcataatgtaaatagtccaaaatccaaaacatctgagcctgaaacatttctgataccaagcatttcagataagggttactcaacctgtagtacaaagattcctgttctaaattgaaaattttgattctagttcaaaaacaaagcctaaatgacttattttaggatttgtcaagtatttaagggacatataacagcagtttcatgattcaataagatccctttcagcagttatcatgctaattattttatcaagctcctatacataatttaattatgcatttgtttcttttctgtggctcctgattttcatatttgtttgtgtgtacatgtttgttcttctccttaagtatatttttagtgcaaaaaatctatttaaaaattatatttaaaaatatgaatttttagattttttttttttgaggcagtgtctcactttgctgcccaggccggagtgcagtgacataatcttggctcactgcagccttgacctccccaggctcaggtgatcctcccacctcagcctcccaaggaactgggaccacaggcatgtgccaccatacccagctaacttttttttttttttgtatttttagtaaagacagggtttcaccatgtttcccaggctggtcttgaactcctgggctcaagaaatccaccagccttggcctcccaaagtgctggaattacaggcatgagccaccaaatccagcccttaagtagattataagtaggaaaggctaagactgtttcttttactacttttgtgagactgtatatagcaaagtcattaacagtgtgatatttggagggaaattgctgttttcaagacctggatctccactacttactggctatgagacctaagggctgggattagagtgaagcaaggaaggccattaaccttggaagcaaaatttaaaggagcacaaaaagttagtgatcaagataaatattttaatacaacatttttaaaaatcagaagttagggaaaatccatggtgaacaaaacatcaaatttgtaaataaaggcagactgttgcttgtgtgtttttcagaccttgctacatttatattgtttaaggaacagtattttccaatcaacttgttgttcatggccattgtgtcccccaagggccaacccttatgggttgacattggcaagagagcagattgagctattcatggctttataactgtcttaatctattttgtgctgctacatgtaacagaatatctgaaactaagaaatttataaacagaacatttattctctcaagttctggaggctgggaagtccaaaatcaaggtgccagcaagttagagcctggtctctgtgcttccaagatggcaccttgaatgctatgttctccagagaggacaaaaatctttgtcctcacatggcagaagagcagaagagagagaactcactactacaagcactttgtagagtggcattaatctatttatgagggcagagccctttggatctcccattaggcttcacctcccaacactatgccattggggattaagtttcaatatgagttttggaagggacaaaaacattcaaaccatagcaatgaatctccgtaattcctcagtttagccaggcacatagtgaatactcatgagatagcaggttgatcataggctggactagataataataagcttgtattattgaacatctattaagtgtcaggactagagtaagtatatcatatatgttacctcattaaatctatatttcccattaaaatgtgggagtctaccaaggtgtgaatccataaagttttagaaatacttattaatattttttaaagtggacaatttttttctttgaagaacaggaaaagaaaaaactggtagaaataaggctgtcacatacaggttcttgcctctatctgtctgtttcctgaagactaggttagctaagagcattattatcaagtaggagttgaggtgtgctctaaacacctatcatcaaaagtgggccaatatgtcatacaaaggcccctttcaatcaacaaattgccctcacccctgtaatctacaactcacatgaaaggttctagctttctaaaatttctattaaatttctcactgtagatacttcagaaaggttttttatttattattattttatagtttggttcttattagtacaaattgtatctgagacttatttgtccccggttctgggcctccttgctttttgatgctgtgacttaaataactcttactttgtgtgatctttgatcaaatttttaacctcaatttattctacatagttgtaagaagtaaataagacttgaaaggactttgcagaattcttagaatatagtaggtgctaaataaatttaaactatgactaataagattatgaaagtttaataatggtcataacataatactagtattatttctccctctcccagtcctaggcatttcgttgtttgcctgtgctaattttttcacctctcctcccatttgctctgtgaaggcagccactcatatgtaagttcttgctactgccccctttataactgaagactctagaatgtcttaggatctccttatattgtaggttacggggcattctttgcaactgaatcccatctttcctaatgaaggaacaaacccttctttctgcaaaagtcaactgcccaggggaaaaaagcaacctttggataagttggaaggttttgtattttttctctatcaactaaaccacctagtcacaatctgctatataataaagaaaaaagcagtttttctcaccagtctccaacttcagcatgtaactgctctttttcccacaacaaagtgacagttgatggaactgttccaaatggcattcatatactaaatgaccaaggagcattttcaactctaaaatcctgacacacaaaaaagcaagaggctgccaaacgtacctgtgccaaaagatctgcagggggtacctgccttcttaattattgacctccagacttgccagtgctgagtgacatgctctccactttcttctcctgtccccacccaatacttagagctcctctgggggatcctatctctgtaatacagtctttctcccttcttcttttgctcttcttccttaggaaaacagcagcacggattcttgggtccttctttctaagggtataaaggtatgtaaattgctgcaggaaaaagaattcagcagagtatgattatttgcaggcaataacacaatactatctgtatgtaagactgacacaaatcctagccagattcagctaaagaacggtgtcttacataagagtttctactaagtatattctggaattttctatttaaactatttaagaagtctaccttagtccatcctctgtttctgcccatacttgaatgtggtttccatttcttgtagcctgatctgtctcatttttaaaactagagattccaattcatagatcttatcattattttgtaacatttcccccattgaatgcactcctgtttacccttctccattttacttccctccatttcccctgatgactgtacacaaggattcatctgttgtttagagttaggccagtagatgtcagccctggatctcctgagtaccttaaaagcaattgtcctagctatggccttatcccagacagactgaattagaatctctagaagacaagcttgtgcatcagagtgttttaaaagcagctcaactgagaatgttgagtcatactaacaggatatgaagacctaacccatcctctacccttgtgcccgtcaagaatcccctccttactgggcccctagtgagcacttttattgacatcaaccaacactgtgacaccccagggagtttgtccaaaaaaattccaggcacagagagaatagtagggcttttcatcacagaccgaagaaaggatacgggatagaagaaccaagtacctcaaatatactctgatctccaaaattcagattaacattttcaggctactcttcatgcatcctctttgaagctaacacaaacacagaagaaagggaataaggttaggaccagaacaaggctgtgaaatgaggcaaggagctgccccagggcacaaaatttaaggaggtactcactgttgggtgtcaacatttcacttgcaagactttgagaatgccactttacctgatcctagtccaggctcggggaggagctgacaaagagtcattttctaaaggaatttagggatagctgtaatcatccagtttaaatgaagattttatgaaatcttcacactgatacagtcttctcatcttagcagtaagatgtcagaacttcttaaataaaaattaaaatctgccattagtcctgcccattccaaaccccaaatcctgctccagatatacagttcatagaagattatgaaggagaagctctagtcagaagaacagaatgcttccatttgttaggagagggtaacaatagtttttaactgaaagtcaagtgtatcatactttctctagtaatatactaaatgtcttctaatttcaatccttcattcttcctctctactttacaaaaagtaaatgaatcagtgcttgtcgaatgcctagttcagagctggcacagttgaggactcaataactggtaacaatttttctcaccaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttggtaagggcttttgttctacagactcactggcatcctcctgtctcctgccctgctcttccttgaagaggaagcaccctattatgctgcagagcagccacatgtgggtaacagtgctggagtctgtttccctggatacttgtcattcttgttgggcagggggatgagggtaggatgctaaagaatgatgattctgttaacagaataaaatcatacagaagccaataattttctgtattggtcagttttctgttgcttacaatgaaatacctgaaactgagtaatttgtaaagaaaaggaatttattacttacagttatggaggctaagtccaaggtcgaggggacgcatctggtaagagccttcttgcggatggggactctctgaagaatcccaaggtggcacacggtatcacatggcgaggggacagagtttgctaatgtgctaactcaggtctctcttcctcttcttataaggccaccagtttccctcccattataactcatgactccagtaacccattaatccatgaatggattaatcttattcataagggcagagacctcatgattcaatcacctctgaaaggccccagctctcaatactgccacactggagattaagtttcaatatgaattttggagtggacattcaaaccataacagacagaacaatttcctggtgaccactatcttatttacaatgttaatatttctcagaatactggaaatctctttaattgtaactgccaaaatctaattgtttagttgtctaattgtcttagttgcttgcttgagcaaggtggagtaaagtcagtgagaaaaggaaggtgataaatatagccccagagaaactgcagaagttcctcctcccctgctatcctgccaaggcccagctggggtgagaccatccaggtccagcccttccagcaaaggagcctttaggaaaggccctctgaacctgcactctcaggagtgtggagctgagctgtgaaatccactgtggcctcactcaaaatgcagactatctgcagcgtgccaatttaaggaggaaaggttaaaattctattttccccagtggtacaaggaagtaccactaattaataaacaccattaatgaagggaagcctctgcctttggatgtttttttcattttttgtgacaaagatctgtgttttttagaaagtcaattttaaagaaggcaaagagaaaagcagtgaggtggatagacaattaattatttttgaaaatgagataaacaaagagaaaataacttcacaaacctatggacacaggctgctagattgttcctcaattctctaaagggcagagcaagcaaaaaaaaattatttggaattgtattgccctattattggcagtcatacaatttagtattttgaagaaaacacaaaattgcctcccccttccctcctctgtcctccccttccctctgcatcctcccccttctctttctcttcatctctcctcagggatggactaggcaataatcatccctgatgatcaggttccttacggagcctaaacagtgtcctgtgaagagttggaaacaagctgttcatctcttttgctatcaccatttgtttatttaccaggctgtgactgtcttagtgcaaacatgaaactgcttcatctggtctattgtcaaaccaatgaaggcagccatcctcaatgtagaaagaaatatcaattttaatctaggcaagctgtgtcccctattgatcaagactttttgcatcataacttgatctaattgccttgtcaacatttatgctgtgtcctgtatctctttgctgcattaaaacacctctatcttgatcttaaatgtttttcagccttctatatctcatttttatcaccctattggattctacagctctttgtctctacatttctcttgtttcttctttgaagtcctttcggtggatgcttaaaaatatgaaaccctgcctgcttgttcagaaaattagatttttcgtgcttcctggtttttgcatttagtaaattggctgggcgggttgtgtttgggtggagtctcatccagtccttaacctattttgaggtgttacccaagtatatattgtggccctgaccacatatcttataagaacctactttacatcccttggtgattcctcatatagaataagtctccccaaaacacccatgaaaaccttgaaatcaatacccaaatatatatcagatctattccacatgccctaaacccagcatatttcttcttcccaaacaatgtccattgctcaactcttcattgtctaacagaccagggacaagaggggctactccagcaattttgccacttcctgcatctccttcactggtctcctttggttttcctttccttggcagggagtcacctgcccatcacagggttctgttccactcctaaattccaaatctgattgtcctcaacctcaaagaaaatctgtctcaccctgtcacctctgcaatttttagtagttgttctttctttcagggcttttattctgctggtatttgttaacaggaggtaagagatacctctccatccattagtgtttcaggttgtatcttggttttgggttcccctgaaataaaacatcgagataaggattgcggttaatttatttgaaaggccatcctgggaaacatcagaaaaggagtgagaaagtgagtcagggaagggaaggaagataagaaaatgtacaagattatatcagttagcaccataggtttagagctcatcttactgggagacagcatagaacacacatcagagttatcccacatgaagggcaagaaagctggggtattcatctaccatctctccatctgtatcactattaactctctgggactcccagtttttactacttgtggactaagtatactcccataatctcaataaatcattatgcaaagagtcatctagtcatcaaagagttatcccagtaagagatcttcagtatgccaaggtaaatggctagtggctgtagcaggcactgacagcatctgtgactggaggtttagcattctttccactgagtcatagaaggctgtgtttgctatgctcaagaatttacttgaagccacttctgttcaacacgatgtacttaatgtctagtttgtgctgggcagttaagtgctagagatgaagaaattgataaaatactggctcagaggcacttaaaatctagtaaaacaacaaaatcactgaaatattccctgatatttcctagtgccaagcaaccaaacaagaatcaaatgtttctctgctccacttcagggacctttataatgagactttatttctaagctgcattagttcattttcatgctgctgataaagacatacccaaaactgggaagaaaaagagatttagttggacttaaagttccacatggctggggaggcctcagaatcatggcaggaggtgaaaggcacttcttacatggcagcagcaacagaaaaatgaggaaaatcaaaagcataaatgcctgataaacccattagatctcatgagacttattcactatagcatggtaaagaccagccctcatgattcaattgcctcccaccaggtcccttctgggagacacaattcaagttgagatttgggtggggacacagccaaaccatataatttcacccatggcctgtcccaaatctcatgtcctcacatttcaaaatcaatcatgccttcccaacagtcccccaaattctcaacccatttcagcattaacccaaaagtccaagtccaaagtcccatctgagacaaggcaagtcccttctgcctatgagcctgtaaaatcaaacgcaagttagttactttctagatataatgggggtataagcattcagtaaatacaaccattctaaatgggagaaattggccaaaacaaaggggctgcaggccccatgcaagtccaaaatccaaaagggcagtcaaatcttaaagttccaaaatgatctcctttgactctatgtcttgcatctgggtcacacagatgcaagaggtaggttcccatgttcttaggcagttccgtccctgtggctttacagggtacagcctccctcctggctgctttcacaggctagtgttgagtgtctgcagctttttcaggagcacagtgcaatctgttggtggatctaccattctggggtctggaggatggtggccctcttctcacagctccactagtcagtgccccattagggactctgtgtgggggctccaaccccacatttcccttctgcactgcccaagcagaggttcttcatgagggccccgcccttgcagcaaacttttgctgggtattcagacatttccataaatcttctgaaatctaggtagatgttcccaaacctcagttcttgacttctctgcacgcacaggctcaacaccatgtggaagctgccaaggcttggggattccacacttttagaagcaatggcccaagctgcacgttggcccctttcagccatagctggaatggctgggacacagggcaccaagtcccgaggctgcacacagcaaggggaccctgggcccagcccaggaaaccactttttcctcctgggcctctggacctgtgatgggaggggctgctgtgaaggtctctgatgtggcctggggacattttccccatggtcttgtagattaacattaggctccttcctacttatgcaaatttcggcagccagcttgaatttctccctagaaaatgggtttctcttttctattgcatagtcaggctgcaaattttccaaactttcatgctctgcttcccttataaaactgagtgcctttaacagcacccaatacacctctcgaatgctttgctgcttagaaatttctcctgccagacaccctaaatcatctcttgtaagtccaaagttccacaaatctctagggcataggcaaaatgctgccagtctctttgctaaaacataacaagagtcacctttgctccagttcccaacaagttcctcatctctatctgagaccacttcagcctcaaccttattgttcatatcaccatcagcatttttgtcaaagtgattcaacaaatctctaggaggttccaaactttacaacattttctcgtcttcttctgagccctccaaactgtttcatcctctgcctgttacccagttccaaagttgcatccacatttttgggtatattttcagcaacactcgactgtactggtactaatttattgtattagtctgttttcacactgctgataaagacatacccaagactgggaagaaaaagaagtttaattggacttacagttccacatggctggggaggcctcagaatcatggtgcgtggtgaaaggtacttcttacacagcaatgggaagagaaaaatggggagaagcaaaggcggaaatccctgatagacccaccagatctcatgaaacttattcactatcatgagaatagcatgggaaagaccagcccccgtgattcaattacctctcgctgggtctcttccacaacacatgggaattctgggagatacaattcaagttgagatttgagtgaggacagagccaaaccatatcataagcctttggacatgtagaacattgctcttttctctccctccccaccacccatcctccgcttgcactaccagtcttccacattcccaattttacttgactcatcactgataaccacatcacatcttccaaaagcctcctcctatcctccaaggttaggttagaaaatttatttaaaagctgtcttcaaatcctacatgtccttaatcattgcacttatctcagtgtattgtaacttccagtttgtttatctgtattcccatgaaactgtagatttcttaagaacagtgaatattatttgtccacatttgtttcctaagcatctagcatactgccaggtacacagtgggcctggcagtattatattaataaatattaatttataaatattaatatttaatgaatgaagatgcttatagacacacacacacatacacacactagtggccaggtaggatgacatttggtgccactaactatgttttatttgcctttaagctaaaccagaaatccctgtgattgtggaaaataactccacggatgtcttggtagaggtgagtcacataaaagcctttgaaaatctacagtattacatgtaaggtgtgtcaggttgcatagttgccaggaatgttctctcaaagaactttactccttggcccttgaccaattaactgctaatagggatgaagggaagctgggttgtttctagaaagtgaatgggaatttttacttttagacttagggctctcagaatgtttgatgtgcacttttagtccttaaatttctcagaaaaaaaaatagtcacaatttgtttaaacttctcttttataaaaattcaggtggatagtgaggacaaagtagggcagaaagcagtgtgagccctggtgtaagaaggaggcttttgctcagctgacgtttaatttgttctaatccatttcctttacccactttcccattgtttttatttcaaagtgacaggaggagatatgccctcctgtactcctgcagaaccctgggtatgtctttggtagtaatgaagaagggcaggagaaaaaagaaaattgaatagggacctctgacttaacttcttctgggtggtagttaccagcctgtagtcactaggatctggactcaatttctcgctctttctcttgcgagctgtgaccttgggcaaattacttcatgtctttgcagtcagtttccccatctatatgaagtgaataataatagtatcttcacattgttgctgtttttaaaaattaaataacatatgaaaaaatctaagtacagtgtgtgacatatattaagtgtttaataaacattattgttcttgtttttgttattattattatctgtgttaatcaactgtcttgtggccttatgactttagccaagcttttaaaaaccctaagtaaaaaatatactcattaattctctaacattttctattacatggggcgagagaaaattatattcattctagtttcttctcgcaccaataacattaaataacttacaatctctggtcttactgaatattagtcatttaatttgataattgcatacaaatcatagcttagattgtttgagatggttttgcataacttggaaaaatatcttccaagtagttgtgtcttttgccagtttcatatattagtctcttaggtaactgcttgtattagtccattttcatgctgccagtaaagacacacccaagactgggtaatttatacagggaaaagagtttaattggacttacagttgcacatagctggggaagcctgacaatcatggcggaaggcaagaaggagcacatcatgtcttacatggatggcagagggcaaaaagacaatgtgcaggaaaactcccccttataataaccatcagatctcatgagacttactcactatcatgataacagcacaggaaagtccccatgcttcaattacctcccaccaggtccctcccacaacacgtgggaattcgagattagatttgggtggtgacacagccaaaccatatcattccacctctgacctctcccaaatctcatgtcctcacatttcaaaaccaatcattcctttccaacagtcccccaaagtcttaactcattgcagcattaactcaaaagtccagagtccaaagtctcatctgagataaggcaagtcccttctgcctatgaacctgtaaaatcaaaagcatgttagttacatcctagatacaatggagtacaggtattggataaatacagccattccaaatggaagacattggccaaaacaagtctgaaatccagcagggcagtcaaatcttaaggctccaaaatgatctcctttgactccaagactcatatccaggtcatacagatgcaagaggtgggttcccatagtcttaggcagctccacccctgtggctttgcagggtataactcccctcctggctgttttcacaggctggcattgagtgtctgcagcttttccaggcacacagtgcaagctgttggtggatctaccattctgtggtctgaaggatggtagtcctcttctcacatctctgctaggtggtgtcccattagggacacaagctctgccagtgtggctttgcaggatacagcctccctcctggctgctttcatggtctgatgatgagtttctgcagcttttccaggcacacagtgcaagctgtcacggatctaccattctgggatctgaagaatggtggtcctcttctcacagctccactaggcagtagcatagtggggactacttgtggggcctccaaccccacatcttccttttgcactgccctaggtggggttctccatgagggccccgcctgcagcaaacttttgcctgggcatccaggcatttccatacatcttctgaaatgtaggcagaggttcccaaacctcaattcttgacttctgtgcacctacaggctgaacaccacgtggaagcttccaaggcttgggacttccaccctctgaagcagcagcccaagctgtacccttggcccctttcagttatggctggagtggctaggacacagggcaccaagtcccaagactgcgcacagcatggagacctggggcatcacccacaaatccattttttcctcctaaacctctgggcctctgaaggaggggctgctgcaaaagtctccaacatgccctggaaacattttccccattgccttgatgattaacattcagctccttgttacttatgcaaatttctgcagccagcttgattttctctccagaaaatgggattttcttttctatcacattgtcaggctacaaattttccaaacttttattctctgtttatcttttgaaactgaatgcctttaacagcacccaagttacctcttgcatgctttgctgcttagaaattttttctgccagatatcctaaatcatctatcttaagttcaaagttccacagatctctagggtaggggcaaaatgccaccagtctcttaactaaaacataacaagagtcatctttgctccagttcccaacaagttcctcatctccatctgagacaacctcggcctggaccttattgttcatattactattggcatttttgttaaagccattcagcaagtctctaggaagttccaaactttcccatattttcctgtcttcttctgaacccaccaaactgttccaacctctgcctgttacccagttccaaagttgcatccacatttttggttattttttcagcagtgcccactcttctgataccaatttactgtattagtccattttcatactactgataaagacatacccaagactgggtaatttatacaggaaaaaggttataataaccatcagatctcatgagacttactcactgtcacaaaaacagcatgggaaagacctgcccccatgattcagttacctctcactgggagttcaagatgagatttggatgaggacacagccaaaccatatcactgctattataatcctgattatacagcaaaagatttaatcatttttgctgtgttgtaacttaatttctaagtgtattagtgaacttcatttcaatagtttacatttcaaaaataagctaatcatacagcttttggtaggtgtttttgtttctttttttttctttttttttttttttgagatgagtctcactctgtcacccaggctggagtccagtgccgcgatctctgctcactgcaagctccgcctcctgggttcacgctattctcctgcctcagcctcctgagtagctgggattacaggcgcctgccaccatgcctggctaattttttgtatttttagtagagatggggtttcaccgtgttagccagggtggtctcgatgccctgacctcgtgatccgcccgcctcggcctcccagagtgctgggattacaggcatgagccaccatgcccggcctgtttttgttttttataaggatctctaatagattcttggtgccagtgtttacaggtaatatgggctcaatccagatataggaccataaattggatccaagaatcccagttttaaaataaaacaaaaaactttacctaatgtgccataaaatttcctcttctctacccttgctttagtgctaactaagaaaaccagagaattttccttcctagagaattagtgagtaatctttctccaatcacacataaccagctacaggacatggcttgtctatggatcttttcagatcttgccaaacattagtaactcctcactctaatattcttacaatccctgctgtatttttaataatttattaactcttcaaagtcctttcacatacttttatcttgtgctgctcccagtgagcctctgaaatagatagggcatctgtcattttacagatgaaaaattggggcctggaaagtcttaacaactggctgagtcactaataaggggcagagctgggatgcatatttagtgtgcctgtatccaggcagaatagtattattatgatggaaggatatcatgcttcagggtcagatagcacaagtgtcaaattctaattcaactacttagctggttacataccctcatcaattaattaacctccacgagcctcagctaactcatatctaaaactggaataataacaaatacttcagagggttcttaggaaggttaaatttatgctctaatggagttcatggcacatagtatacatttcaggaatatttcttccctacccactatttatcatttacccactctcttacgttcataaatcagctatgtgactgattctagcagatactgtggaataattttttttaacccagaatacagactgtgggatctgatagaactaggtttgaattctcttccagcacttattaactctggcccctaagagctcagttccttaacttcctcaaaagtaaatgagggcaatggctccaacttcacaagggtgatgttaaggatcaagtaagagaatgtatgcaaaatacctaccatccagcaaccacaggtttttggtgttggcaatttcctgcccctccttcattccttagaaattcttgaagtcaacatgcacacactgtctctgctacctgttcactacactagcagcccgcagtgtggaaatactctggggacttggtcagttgtgagctgtgtcttcctgtgttattagttaaacttacaaagtttatggctaattttagtatttctgtaaaatacaagacccaaaagcatgatgcccctcaggcatggacatgccgtagatgtctaaagagagtgtcacacctgtgaatgttgtatcttatgcattcccaaagtcaagattttgccagggctccaacttgacacacagcttcactcctgcactacaatgagaaaagagtctttaacctaaatttcagggcccctccatgtggcaggtttttgtattagagcaaaagatatcaagccaaagagcccctcaactcacagctaatgatgtagcataagaaggcacaagagggatgcataaaagctccagagtgtactcagcagttcagactttccacaagcctcatacgtctctcactcttatgcttgtgctttatactttagccccgtcatctccatgggtcttgttcatatcactcgctacctttgttatgtttgaaataaattaggaaaaaaaatctaaagaaaattatctgtcatgaaacataggaaacaaaagcagtttggggttaagttgcctacaaaggaagagaggctacaatattaataaccatgtaaaacagataccagaggccagaagcagtggctcacgcctgtaatcccaacactttgggaggccgaggtgcgcggatcatgaggtcaagagatccagaccatcctggccaacgtggtgaaaccttgtctgtgctaaaaatacaaaaattagctgggcgtggtggcacgcacctgtagtcccagctactcaggaggcttaggcagaagaattgcttgaacccaggaggcggaggttgcagtgagccaagatcgcgccactgcactcctgcctggcaagagagtgagactccatcttaaaaaaaaaaaaaaaaaaaaaaaaaagacaccagaacctaaataccacactggttggcatcagcagagctccagcatctttgtgcagaatttgattatttgtgtttatttggtttgggttttgcaaagcttgaaccctgtggtttcctcaagcttcctaagccccactccaaaaatatgtgttttggttttcattttttaaataattaggtattacagcctccttttttttcctagcatcttttgcaacataataaggttctgagtccaaatgtccagccgtcgtcacttgcactggtgagcacctgagcttgcaccacaggtagagaaggttctaaaagggcatcatacctctgtggggagaccacatgacaaatgaaatctttaatatcaggcagatctctagataaaaaaagaacatgacgggacttcagtgtggcctggttatttcacaagcctggtgcctggacttttgtttgttctacaaacagctgttagggaagacaggtctagaagtgagggctgcctagcaagtctaggaagaatatgagtgaactacataggtcagggccaaaggaggcaagacaccactgttacacaaggacatcctctgcttccagagaggttggtgcccacaaagtacttgggctatctctgagataatgggatgctgtctttatctattcctgtcttcccaagctctttccccactccatccccattcccaacccacattatgttttgttttttaatgtgtgtgtttggttggaggagggtggtgtggttatagaggaatctgtcttctataacaaatatcaggtccagtgcagaggccagagtactttccagtttgattttattctatttctaaattaatattttaggcatactttcagcagcccaggaaattactctctccctatagactgttaggatctcttttttcaaagcatctctgaacatttaaaggtaaacagtttttaaaaatcagtgaacagtggattggcatgcagttagcatttcagaggtatgagtaaaatctaaaacctactgttcaaataaataactggtctgtaggcacaaagcaaaatcaagttaactcattaaaattaacttcaggatctaagaaaatgtactccatccttccctcattcagacagtcatgttctcttccattttcatgataaattttccctagagcactgtctctcttccccatctttgcatttcttctctatcccatttatttctaactttccttcctctgttctttatttctccttacttcctttatatctctgccttcttttcattctgaatttctttcagttcttcctcactaactccttttcctttgacaaaccttaatatgaaatcagattatattttaactatttatgaataagttttatataatctatactgaatgtttaaactaagtaagttgagaggtttttcatttctctgtgctaattacacattaattagtttaagcattaggttgttaaaaagacacaccggactcagattatactgatgaaacaactttaatataagcaagaaaatacattgcagcaataacaggagaaagagacgcattggaaaggtccaaagatctgaggctcacagttctttgtccttccacttgctgggtcacacagaacaagcttttattcatactggtggtctggaaactccaccagtacatgtgctaagacctcagtcctaggaagattaagctctgcttccggcagggtgtctgcaagtgagctggtcacataggcacattccagctacctaaccagcctcagccctcaaaatcgtcagctccaccaaaaccgagtgctaggcaaaaatctgattattttgttaaacaacgctgactggctggtacattctgccctgaaacaactcacagagttttactttggtagaagcatttatctttaataggtacattttagagtttcggccaagggtcagcagagctctaggaacctcgtagataagcatttggtcaattcagacctgctcagattaactcatactgtgcactatttcacataaaagcaaaatgtcaccaaactactttgctttacatttgagttgaaactaaaatggctcttttctacaagtctagagtcaatgttttcagaatagattctccaagcccaatttaaacaaaatggaagggatgtactgctgcaggcagctctttctcccgctggcatgcctccttctcagccctcaccttccacttcatctccaggatggccctttccacctcctccagggctcgctcccttttttccacagccctctcccgccattccactgccctttccctcctaagcacctccttttccctttggctggcccacaaagccatggtgcccacctgctccaggagcctaccccagttaccctcaatgcctgtggggagctggggcccgtggggccttggatcctggcgctgcccagcctgaccatggccactcttctccagctcctctctgtgcatgcttttcagatgcttccacagtgcagtggtgcccacgttgaccccagggccacggctcacctgcctgccacacaggcggcaggtggcatactggttgggatggtgcccagcacgagcaggagctaggtggaaatattcccatgcctcagagaaccgggtgcccttgttgtggggcattggagtgggcatagcactcacaaaagggccaaccagttctcctgtctcactaatctcttcctcctccttcatctctaagtccccttttgccttcatcattgttccctcctcttcctcgtcttcccgcctcatcatgtcacctcttctacagcgttctttatgatgtgcttagatgtgagccaaaagcttatttgaaccacaagattaaatatatatttgggaagggcctgtggtaactcttggggattcacaataatggccaaagtctggccacacctgggtggtgtgaggtttcttcctttctgcttcactggagagtcaggggtgagtcagatacaagcaaaacagcccaagagtgcattccttccatgccccagatacttacttatcctcccttgactaggccagaaagacaaaacatatcagttcctgtagcaaaggggttctctggtccaacaattacaaagctctttgatgaactcagtgttttctgcatcaaccaccacgacaggtatttttgaatattgaaaattttaggttttcctgtttctcctcctggttgtttccactgtttctgtgcttcttatttcctataattgcattttggaggcaggagaaacagcctcagggttcaggcttttcaggaccaacagagctagggcctcactgggtcttgctcaaagtaggtaaaagcaaacacaggcagatgctggtgcaggagacaatcttgcttcctaagaactgttgcaacaagcaatccagagtagacaaagcctatgaggatctggataataaagttcccaatgcaaggtcagtttgtccttagaggtgtctctcagaggccaggagtctaagaaatccaaaaagcaagctcagctgtttcagcaggaggagctgggatgcacagaggagaaggtggagcacatcttcacaaacacagtgttgcctggctgtccttagcaagcagctcaccatactccaccttctccaccaggatcacctgcaaagccaacagccaataagaccttcctgaggcaacttactccagatgttttgctctttacctcattttaaagataaataagtaaatggaaaatcatattacatttaaaaacagcccgacttctctctcctttcttgggtcatttcttaaactaatgagagctttatttaatcaagctctgcaaccgtgaacagttaggaaattccccccagccacaagtgggtacttacaagcaggcaaggctctggacttctctctgatctttcctgcgcagagtgaaagcactcctgcacaccttggatgtctattagctgactcctacccccagaaggagggcacctccagttctggtttcctcccacttctagggaagcattgtttccaggtaggtgtgtctgtgcctgttgggtttttctgcaacacttagacacagatgcaaaccttttctccaccccctccaccaccaagaaaaggatgttcctggcatatgtcatgcagcaaaacagtaagtcaagcacctacaagtcttagttctcttttttgatgactagattacctaacctctcaagtaaagcaagcgatttgaaggaggaagagtgggaaaggctgaaatattaaatgtatacacacatatatattatatatatacatacattatatataatatgcataatatatatatgtgtgtgtatacatatttagattgagaaggaaaacctaccaagaggagataggaagactctaaagaaggtatcaatagaagaagaaaaaactttgtgttataaaaggaaagatagaaatggcattgcaggccaggagccatggatcttgcctgtagtcccagcactttgggaggccgaggcaggtggatcacttgaggtcaggagatcgtggccagcttggccaacattgtgaaaccctgtctctactaaaaatgcaaaaattagccaggtgtggtggtgcacgcctgtaatcccagctacttgggaggctgaagcaagagaattgcttgaacccgggaggtggaggttgcagtaagccaagatcatgccactgcactccagcctgggcgacagagggagactctgtctcaaaaaaaataaataaataaaatgaataaataaaaataaaaaaagaaagaaaagaaaaagaaatggcatagcagaaaatatgtagaggttgacagttaaattaaaatagaaaaaaaagatgggggaaaaagattcaaaataggaatgagactgggaggagttttagaacatgaaccacatttctaaaccaaatcttggaacgcaaagtctagagagagtctagaatgtttgaaatttggatcatttcagaaaatctgaacctagagaattcatgaaagtcaaatcttttcaaaatttttagacgttaaccagagttcttcagtgagccagttgccttcgtaaaataataacacccccacttactcctgatattaccatatcgtcatctttggtgggttaactaaagagaaaggaaatgaatcataagaatggttaatgtcactggattaatgcaaaactttgtatctttttctttttttaaaaaaacattttacctcctttacctttttgtctcttcctggaccaactggagataaaaatcaatctttggcatctattgaattaaactgaacactctcctttacttaataagaatgtattttagaggatctggttttgcttttaattttttagtggagagactagcatccctggcccatatatgtatccccattatctggaaaggcaagtgttgaacggatgggaatactgggagctacggtgtttgccacccagcatcttggatatgctagacaaccccctctgaaattctcttgtttcattgggatttctgtagcaatgtactgagaaatagtaaacttctgtaggatttcaccaggaaaatgttagttagcattctcgaatttggtttctcagctctataggcccagacttcttgggagtaactagtctgaggattggcacacaaatcatcacatacatttaattgttctttacatgttaactagtatattcattaattgtggaaaatatctgagaactaagaactagggctggtcatatgtaaaatatatacatctcttgatgagaaaacaagtaattataaaaggaattataattttgaagagtctcagataaaacaatgggaatccaataattctcactggatattttcaccagactgtaaaagaaagtatcatcccccaaagaacaaacatagcattgaaaataaaacataactagccctgcatctaagttctctgctttcataatatagttacttctttcatttttttatttcaatacaatttttattaaaaaatatgttggactgagattaaggagacatggtttctaattgtgccattaactattttccacttcctcgaaccactgggtgccttgatttttccattggtcaaatggcaaaaataaggcatgctctacctatccttaagattaagccaatgaattgtttttaaaaattaggaaaatgcttcacaagtaaaaagtaggatatttatataaatcgttttctgtgattgttacaaatagtgtcgtacattatttggagcacagaaacagcttgtagatccccttgagcttttaatctaacagactattcttctctggcctctgtttgctatagcttcttccttctattctttggtttccatttagtattattttattctgcctacacagagttaagatttctcctttacagaacccagaatccagacttggaacattagtatagtcctagatccttaagttgacctaggagtatagccagaagtttataacatctctataggagatagcccatttatagtgcacgttctaacacaacctatattaaaagtagacattgccttctatttattcagttaaaaatggagaaactcttttttgccaacttatatgaatgttagtaagttgtaaggagtaccagtttcttaggaatttgcaaataatcctttttctgtctttaccccagagaagatttacctgcttactaaagaatgtatttcccaaagcaaatatcacatggtttatagatggaagttttcttcatgatgaaaaagaaggtaaggaaactaatcaatggaaataagttcggtacaaaaagaaagaaaacaaagaacattagaaattgtcattgcccaagttgatcttggcatttaagaatgattctcattccaagaaaaacatcattctgcctaccaaatgtcattttctgatgcttcatctgtttcttccaagggggtggagtgtaacattttccagaataaaagaaatacaattgatttagacaaacaacatccaaatattttatttaactagcagtaaaaggaatatcttaaatgaggacaaaaagtttaagtctacatatatttattaaaactttttctgcctttataacatagctacctgtttttccatgtctttcttatttcaatacaatatgttcaattaacttagcaccgctgctttaaatcagccaataaataatttctacctttttatgtgagaatctgaggcaggtgttggtggagcactagagaaagcctatgtaaaagagttggctccttgacaaggtacatgttccccaggaggattaaaagttcctggaggaggaacacacatcaagacaagctcaggtgaaaattcacaaagccatgattttatagatagtaaccatgacagcctctaccagaataatctcagctgtccctgcctgaacaacagctattctcctttctcctgagtcgtttttcctccaagttcaatctgtcttcaataataactgagtcacacaactctttctgaattatttttattttattttattttattttattttgagacggagtctggctctgttgcccaagctggagtgcagtggggcgatctcggctcattgcaagctccgcctcccgggttcacgccattctcctgcctcagcctcccgagtagctgggactacaggcgcccgccactacgcccggctaattttttgtatttttagatgagtcggggtttcaccgtgttagccaggatggtctcgatctcctgacctcgtgatccgcccgcctcagcctcccaaagtactgggattacaggcttgagccaccgcgcccagccctttctgaattatttttaaatgataaaattgaaagcttatgttaatgagtgtattgatcacttgatgcattttgagattattattggttttattagtttatttttaaaaaaaattcacccacaacaatgacagaatgcaattctaaaaatataggttaaaagttattataggccaggcgcagtggcacacacttgtaatctcagcactttgggaggccgaagggtgtggattacctgaggttaggagttcgagaccagcctaactaacatggtaaaaccccgtctctactaaaaatacaaaaaaatagctgggtgtgatggtgggcatgtgtaataccagctacttgggaggctgaggcaggagaatcgcttgaacctgggaagcaaaggttgcagtgaaccaagattgcgccattgcactccagcctgggcaacaagagtgaaaccctatctcaaaaaaaaaaaaagttattataaatttattctcctgttaaataagccctgcataggcaaagcacccagatttcaccaaactagaggctagattttgtggtcagaattgcactggcacacaactgcatttagctattactttggtaagtaattacatcagaattggtgttaagaatctgtaatgtgaaaaagctgtaagaatccagaaaattctgacatatagggatagttggttttacattaattttctgctgccaagtatgctattgggaggttgtactaacataacagtttaaaacagagtttgatttctaaagaagactcacaggacccaaaatgcaatgcttacaaatctacagcttatttcaagaagaggagacaacatagcaaaaagattacaatatgcagcatatcctatcctacacttacagccaggagtccagagaagtcagaatgagctccttcgtgcttcctctctaagggccacagccagacacactttccttcgttcagatcagaaactactgggtttttcccccgaaagagctcagaaaggggtagtccaaaaacggggtcccaccgggaagggttttaattttagggggcctttaggataattctgggacaaaaaccggattcccacagaaaggtttttccccaaaaccgcccttaaaaccaggggggaaaaaatataaaagtccccccagggtggggaaaaaaagacacaaaatttttttttagaaaaatttgggggagaaaaaaaaaaaggggggcccccaaaaaaattttttttgtgggaaccccagctgggggggcgggaggtaaggagggaggcgctttattttttgtgagagggacgaatttttttatattttttctccgcacccctctcttaaaataatttattgggaggggggtggtgaggagccgccacgccgccgaagatttaaataagaataagggggggagaagagagattatttttggtgggaaaaaaaaagagagggcggtcccccacccccgccccccccnnnnnnnnnnnnnnnnnnnntaactggacatgcttttttttttactggccacttaggtatattcctgcaacataaccagattccacagcagagctctcccaagatccgacctagactaggtataaattatcagtctcacagttgtcaacacacaatgctgatgagctgggataatctgccccaaaacattttggacacatggtcacaaacaaagcaacactattagtcaacatattttataccctgaccatggatcaatgacatgcaggagcttgagcaaacagctcaagttaatttcagatctgctgaaattgactctcactgcagagaagctgccatttgaccactttagactctacattaccacaaattgatcatgccatgccttggcattattgtatggctcatacataaaatgttagtgttgaaccatgttcgtatctgtctggcaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggtgagttgtctatttaataagatcaacaagagtttgctaagactgccataaattcaaaatatctttaatgggaagattatcacttccataacgttttaatctcagaaaactttttatgtaactcaaaactatttcaagttatcaaacatttttgacaagtaggactccagtgaaaagaattcttcaactaaaaagaaaatagttgattcatgttttcacaagaatttctgctgcatacagaaaattttttgttccaatttaattcatcataactcttaattagttagcatttttgttaatccatcacatattgaaaattaatactaatactgatgatcaagaaagatttaaaagacctaaaattccttctgcatcattagaaacattccattatgtacaacatatatacttttaatatttaggaatggataaaatgtgtacaataaaaataccataaaaatagggattgtatcttaataattgtagtatccctaggttcaagcactatagttagctaatagaagatttttatgattgaaaattgatatataggattactctagttattatatcatttgactaaccagagtatttactaccctgaaccagatggaataatggagattttactacataaaagatgaactaatacctcaataaatacagtgacaacagatatgcctgaagaaaaatagaagcaatggcaactgtcagatattcatatttaacagtaatcttataaaacgtaaatagatttgcaaatcattattacaactctataggagcattgacctcttaaaccacatcctattttcagagatatcataatctataacatactcataaaaacacagaataatttaagaaggaaacagtttttctttgttacaagggcacaacccgcatcttgggttctgtccagctccttcacaggtgcagtggttggttatgaagaaaagtgtacccagcataaatctatccctactactcagaagcaggtgtgattctgatgccggggcactggcatcgctcccgtagccttgcctgtgtgtctgtgtatatgtatatgtatgaacacatcatcctgtgtactttgagttaatcattcagaaattgtgatgtatttacactaaaatagccttactcaacttcatctaattccctcaggaataagtcagctccttcctggaaagctggacataatagggctgcagtcttggaacaatgtggaggtagctgattctcacatagatttgtcagtagctttggcagaatctaaggatgtgagctaaaggaccctaaaagctcaaattcctaaaaagaaccctattcccattataggtagaaccatgtctgtaaaactaatattttctgatgttaaaacagtgcttgatttcagtatcagaaaataatgaatacctttttaggtaataggaagaacactgattctgatactgaaaacataccataattccaattgtatagggcagagcttgatctagtataatttggggctctgaacaggtggttaattttaaattgccaaatgagtctttatcctttatgatcaaatattaaagacaattaatctttaggagttcagtttctcaaaattatagcttacattctcatcccattctggcatatatctatgtgactgacttagaagatgtagtcaaggctctataaagcagtgtcatcactgtattatgtctccctattgttgcaagctcttaaacacttacttccacacaggctgtctgtctgtgatggtactgccggatgctttatgaactccggagtaaacttctgatgtgtggtgcaagagtcattgccttaccaagctatttattgttgacaagatactgagatgaagacacagaagaaaaatctgccatccctgagtgctagattagagaaacgctaagaatattacacatcaggaaagagttttagtgagacaaggggagaagttttgctctctttgatcccttttgcttccagaaaagggtattaatgttggagactgtgaggtaacagccctttgaggtgattccttctccacctacgcccagtctcccaagtgttcagtgatccctattctagaaaactcagacagggcatgggattagggttagggtgatcagtgactcttcaggcagctatttgtgcactaggacctgcagaattcccatgatccacagtaactaccactaagaaaaaaaagcctttcaaaaatatcatggaccaggcacagtggctcatgcctgcaatcccagaactttgggaggctgaagcaggaggattgcttaagtgcagaagttcaagatcagcctggacaatatagtgacactttgtctctaccaaaaaattcaaaaaatcagccgggcatggtggcgcacatcattagtccctgttacctcgggaggctgaggtgggaggattgcatgagcccaggaggctgaagctccagtgagccgtgatcatgccactacactccagcctgggcaacagagcaaggctttgtctcaaaaaaaaaaaaaaatcccgccctgctagcatgtcaaaatgtctaaaatcatggcactgctgagtctatttctggcagatttgaagagctgggttttgtgggttttgttttggggagtggataggagacattttgtcttgttttaatgcaaaagttgagtgcaataccccctggggtggataatattttggttgtcatctcccttgacagagatttgtttattaaatggatttctgactgtagctgttgagatcaagacctttgggatagaaacagagttaagcattgacagttgtgtaggtgtatgtgtgtgtaagtatgcatgtgtatcttcgcatgtagaaagaggagtaataaaaagatatcttaatagtggaacaggaggaccactgcatattggtgtggaagatgccagacaaatacttcctgtttcatgacttccctcagtgcagctggcctcatacccttgactgatcctttctgagagtatcagttgagaactttaatatgcatataaatcacccagggatcttgctaaaatacaaaaattctgattaagtaaatctaggtgggacctgagattctgcatttgtaaaaagaccctcaaagaaacatattctgcttgtctatggacaacattttgagaagaaaggacctagcaagccctgggatttggcttacttctaggtggatgagataagggcttatacaagctctgaggaaaccccggaattaagccagttgccctatgggacagacccatggctgctgctgcccatgagggtggttctgagagccctgccaagcctactcaaatggtcacacccaggaacagatgaagtggctttaggcggcagcttaccctcttatgacattatggtaaatgcaatgatctggaactgccagaggtgtttctgctaattctgcctttgggttttgggaaatgcctccctttttaagttttaccactcttttctacccctgagttttgttttgaccaaggcagagtttccactttacagtctaatctaaaactagacagacatgtttaggtcccacattttatgtgaaagctatgtttcccctctgtcacaaggcaaagtgttcatctcaaaatgcacatcttacaataatatcttcttaatacactatgaggctgaacacctcagcttacaaaatcacttggtgatgaaatatggcagaaaagtatcctcaaactgaaatgttcaatcaatgaaaaataaatgtttcccattgtggaaactgagcataacgcaccaatatcttctgttccaggaactggcaaccttcttctgtaaagagctagatagtaaatatattttaggctttgtagactttttaatctctatcacaattactcaactctgtcaccttagcacaaaagcaaccatggacaataggttaaaagaaaaaaagggaaaaactgtgttccaataaaatttttataaacatgatttcactgtaggccatagtttgccaacctctattttaatcaatatacagagaaaaacatctaggcatttattttccaagccaatgtcctgtcttattaaggtaccactttggaagataatgcttatgatccaccagctgtcagacacacacttaatgctggtcttctttctttcagtgttaagaataaatttgcatgcattgattcatctacttccatttgccagaatccataaatatggtgtggagcaaaacagtgacttcccttgaggggcatatatgatgacacagtgatgaggcatttgctagggtaaacactgaggggtgatcacatcacaaagatccccaggcttcctcagcttgagaaggtacattcaggaaagtttggggtcaggaaaccacataaattaagatcaagaagtcccagaagtcacagagagaatattgtgtttcagaaattgggttgaaatattgcttattggatagaggggattatttgagagagatggaaaaaatgataagcaacatcaggaaattgggagtgtaatgacagcccaaatcataattagacttgtgtgtcatgctgaagagttcaaacttattttggatgtatgaagaaaaaggatggtcattttgttaacctattcatatacttcccatataaccgtcctccacctcctcagagattatttgcacaaaagcattcatatagtagtggatcagagctagctatgagtgccacccacagccactggcaatagcagtgctactagcaataagaatagaacatacatgcatctagcttagaaaaaccaattcctcccacggggctatgtgctatcaagtgacataatgtaagtaaaatatacttgtcccttaaagtacattacagaatagaaccaatagtttaattagtaattaaacatccaaataattgatatatatcagcagatgtgtaacactgtaaccagtaacattatatctacaaaaatcataaaatcttctaacttcaaaatcatctaagcacatttaacccacatgttcctaaagtcaatagagccttctggcatttgtaaattgtccttccaataggactatttttaaatacagtaatggagatttaaggaattgacataaatgtaaaatataagtaaaaccacattctagcctctgtttcaactccccccaacacagacacacgcacgcacacacacaaaagaaaaagttgtagccaaacaaaaatattatgacaaaagttgtcatgttagaaagcagaaaaacatcacacatttactaatgttacatccaattgggtagttgtatcattgtttctactcttgctgatataaaaatttttgtgagtttatggattttgtaaactgcatgattacttttcaaacacttgaaaatattaaatgctataatagttttaccaggtcttggtaaagtgtaactttttccagggagccttctcagacctcccaatctttatcagtgccccttcgttgtgttcctgtggccacctatgctttccactgtcatggtactcaacacaatgcttggctgcctagtttccaggccataggccctttaaggacgatcccatgtcttcctcattcatcattatatcccactgccttgaccttaatagggccccaatattgatttgttacatgatgaataaataaaggaaagtgtatttaagaactaagtcaatactttatcttttgattacaatattttgttcattataaatctctttctaatcctttaaggttctgaaatttcctcaacagaccctccactgagtgttacagaatctacccttgacacccaaccttctccagccagcagtgtatctcctgcaagtaagaatgttttcacactgagctattgatttaaccaagcagattgataacgataaaatttcagcaaacttgcatcattcatgcctgtttcttagctatgacttttttggggctgaaattgggttttattttttaacagctttattgagatataattcacgtcacattaacttgcccatttaaaatgtatgatctaatggtttttagtatgttcacagacttgtacaaccatgactacagccaatttcagaacattttcatcatctaataaagaaactcctaaacatattaaagtatcattctcatggcttcaaagagttaacatagcttccaaaatcctttacttaaagccctgggaaaatcaaggtaaataaatattcagtgaggaatttaaattctgtatttattattaaataggttaataaatgacagtcattctccaaaacaatgttctcagtggggagtttaagagattggttgtaaatggggataggccaaaagaggttgaatccttttaaatttaaatttgttctggttcaaattaatgttgacaaagttgactggtaaggactatgaattcagccctcccatctgaggcatcattaataatggaggtcagtctgggtcagcaatgctatggcaaaggagtggcagtgactctcaaaacttgtcattgatgcaacaaatcataaattcccacgtctgtggcttttgtgtctaacaaagaaccatggtgactctctaatacacaaaagcttatattctatgtaaagtagaagtatggctctcatttctcatttaattaaaactatcaattttagctcaaaatgagaactgaaaatggaataaaacaaaagcagtcagtaggaatgaacaattcctttggctggtaacctttggcatgtagcctgcagtcgctgtcacaggttgatacttctcagaaaatgaagcaagtggcagaaaagcttgcaaaccacccatcaaaagtttcatatccatctgattttctcatgttcttaatgttttgtaatttttcttttcttctttttttgaagcctctttttcttctacttttaactcactgccggttaatcatggcatttttcatttaacaagtattagcatattcaaaaataataaaaccttaaatctctctagtatcctgtgtattagttatccattgctgcattaaaaatgccccaaattttagcaaaacatatattgtcgcatatggtttctgggggtcagaaattcaggagcagcctagctggaaggtgctaacctgggttctttcatgaggtgcagtcacaccgttggctgaggcttcagtcatctgaaggcctgactggaactaaagaatctgcttctaagctctagcatatagatggtctcagttcctcagcacatggtcttctctatagctctgcatacaatatggcagttggcttcctctggaccaagtaattcaagaaacagtgtgactaagtcaaaagccatattgcctttttatggcttagtctccaaaattgcatgtcattacttctgctttattttatctactagaagtaagtcactaggtccatcttatactcaaggggatgagaattaggctccaagtctcaaagaatctgtgaacaaattaaagccaccataccctgtcatttagaagtgtctgtaaataaaaggcaatgtggtttgatctttattatgagtggtagacagagcaagcattattgttcccacttgccagatggggactttaagacactgagagcttaagtgatcacatacctagtaagtgacagtgttttgcattcacaccacagtgttatgaccaaatttagttctcaccacattagacaccattttttctccagttggtctaaacatatcgtgagaacaggaaccgtatttgtttttcctcctagcacagagtagagagtcaaaaactattagttgaataactaactgaatgaatgaaataattaataagaataatgttccttcactatgtagatgttatttaatagattatttaatgctaaagaaaaaagataaaaatagatttctgccttcagaaaggttgcagtctacttggaagagaaggtatacacacataaaaataataattcaaaatactaagatgaaaggtggtgtaccttacagaattaaaatgcccagggagaggtacaaaccagtaagtattagactttgaaagttctttgtgagttcatgggctcagaaaatgttacccgggagagatgaaataacttgacctttgaagtatgtattgtatatatttgactcagtggagagctcgaaagaacgttctaaacagagaaaacaaagtgagcatttgtgcagtgacaaagatgtttatgggcatttgagaaagcatcagtagataagtttggatcaaagaggtggtattgtgtaccaaaaaaacagggatgaaaattggaaaatgcaaagtaaacaaagccttgagccccagtttaaggactccaaatgctatcctttatgaaatgggggaaggacctcattccactttattttagaaagaaagtggtattatttattcatcaaatatttattgagcacttactatatatcaggtacctttgtaggtgctgtgaatacagcaatgaacaaaactgaaaaaaaaaatgtcctcatggcatttatattctgctagttaaaagcagacatgaatttcttctagttgcatttttatggggttagtctacatacactaagtgcttatatcagtgcttacaaacacaattcttctgtgacaaaattcaaagcaaaagaaagcagttgttacacttcagaagcctacaatttaatatagttttagtattaatgaaggaaagaaagcacagtcaagtaccatatttgtttaaaaagcaggggggaaaaatgccacctgatctactatcacactaagacgatgtagttgggaagtctgtgcagactcaaaagacctccgtaaaacaaggttccaccacattggacctgaggattgtgttagataagtggttgtcaaccagggtaattttgccactccagaggacctttggcagtgcctggagacattttgggttgtcacaatgagggtaggagggtgctactggcatctagtgtatagaggcctgggatgctgctaaacattgtacaacacagcccagaacagccctcacaacaaagaattatttggttcaaaatgtcaatagtgccaaggccaagaagacttgttttagatcaaggcttaggtgtaattacagtaggtatctcttactttacaaaatcaaatctggatttctgtcaagatggcaacaatagtttatgtttggaataattttctgtttgattttgtatgtcaataaaactcatgttaaaccagtggcagattatgtctaaataaacttatctttttggaataatcactgaattactattgaaaaatccaaattttgccttggcaaactggagggtaattgtgaaatcacacgatgacttcctgcctcagaagctggtaggattcacctttgcatgttctttgaagaaaggaagtgagatgaagtatgtcacggaaaccaacttcaaaggctgtggtttcattccgaattctaagatgtaatgagctttataatccagtcatcattacgaagctgcatgtctggctgcaagcatccaattcttattttttcctcgatgaaaggatattttttaaacaaatgttgaaggtcatgaaagcaatattctttaatgaggggaggagaacttaataactcataacaaactgtaagagttatccagggaagcccagctcaattcaacctgaaccaattcgtgtttgctgagtcccagctgcattctcagcgcagttcaaggaagacaggctgacaagctaagtggcaagatgagacaagtccatgtggaacaatcagagacaactgatgaatccagggtggggctgtacagacacaattcaggagtttccgtcgccttgaggagagagccctgtgcctttcaattcactggctatgatttggctaagagttacgtagcctaagagatgccaacccggtgtggcaatcatccaagacacttattcatgaaactcataagtatggagcgcctacaatgtgtcagggacttttgaggtacaggatacagtgatgaacaagacagacagggctcctgttgcttacagagcttacgatcctgtgtgacccacttgccttgcctcctgttttactgcccatcagtccctttggctctgcctcctattgttatgtctgcacatgacccttagacctgatgatgttgattttaatattaagccctttctaaggacttagctggtcctcactatctgggtctttctattcctggatacttagagtaaaacactaggtccagtctgcctctaaccctcagccagcaccccaggtagacataactgatcttcggcaagtggatgatcagacattgaggggcacagggtaaaggaagcaactgaccaggggatgcaacaaaactactgatttatgagtaagcatgtcagaaatggtgggggatcaacccagaagacatgtcattagatgagattagaagaaagtaaatcagaaattcggcagttgataggggcattggattctagtgttaacaggggaacgccagagagagtctgcaagacagtgagaaggctccagtgatttgtttgtgatagcaacttctgacccctttgctagtcatgccatgcctgtattcaggtgcctcaattgctgtccaatagtttctgcctttatcaacatgtatctgctgctgaaaagtaagaaaagtcagtgagtgctgggggaaaggaagggggatcagggaagtcttcatgcagggtctggaagaaaatactgactcaggtggaagaaagatgagaaatggatcttcacattcgcatcataagcaaaggcgtaaaacaaaatgagtgcaggacatgagaagacaagcaggagttctgacattgcttgttgggagagggctaagggttgattaggtggggtggaacaaggtaaagatgagcttcaactcatttagccccaattcatagcccacagcccagcatgtctcctttatgctggactgaaggtcagtgcccatgttatcctgaccacgcagattgatgaggccgattcaaatgtgtttagatgtagttgaaggcctgtattgtccagttaatgtcactactgtgtttaaacgtcaactaatgggctatgaatcggggctgtgatctgaacaacaaatagccactatggctttttttgtatgtgggaaaatgtcaggaaaacagcagttatgtatatggtaggtgatagttgcaagagcagggagaaaaaagactaaatgatatagatttaaagtggtttaagtttgttttccatgatcacgaaggtggttaaaaaaatgatatgatctgaactagaatgggcatttgtagaaatggagagtgctgcaacagaggctcaccaggattgtctgcctaaatacagggactaaaaaggttttcagagaacaatcatacaaggacctttccattttttccctagcaattacataaaaatgtttaccaactgccatgattgtataataatactaagcaataatattaatatttgttggttgcctccaatgtgtatggactgttctaaactagtaaatgtattttctcattgaatcctcccaacaacacaattacttaggtactattattatcccactttacagatgaagatactgaggcacaaagaggttaaataactcacccaaagtcatgcagaaagtagatgagccagtattgagcccagacagacttcagaccttgagtcctgctgcctcaaagagtacatggttggtgctgaataaatgtctttagacactgaataaatcccttctagtgtgaagctgttataggtcttaggaaaaggtcaaacatgacacctatgcttatattaatctctccctttttcagaccagtgttttcctgagacatgcagcatctgagagtgaagataacatttcctcagttggaaataaattagagaaacccctcctgcatctgtagcccacccccgccatcaacactattatcatataattctcactgtagatatgaatctacagaatccatacaaaactccaatgcttttccttgaatcctgggaaattctgtttattgtatctttttcatcaccttccacctggggcacacaacattctgcagactgttaaaaggatttttcttttttctacatctgtcacctgtaagtcaaggttagccttcttgatgactagtttactttgggtattcatctattcagttactccccttggggtgagattcctcagggtaaaagctatcagttgacctatttttcagtttatttcataattattgagtatctacaagctcaccacatgatgcgtgatgagctctgtcctgcttactgtcatcttccccaagggagtcctgaaaccctttctggaccagtaatccagcaatacacattattattccccatttagtcagcacatgccccaaacaatctgcctcccacatgagaaaaattttatgcagggtttagatttaggtttaggtttcacacctcatgtctcctttatgctgggctgaaggtcagtgcccacgttatcctgaccacacagattgatgaagctgattcaaatgatgaagctgattcaaatgatgaagctgattcaaatgtgtttagatgtagttgaaggcctatattgtccagttaatgtcactactgtgtttaaaggctctttgtgctgcaggtgaattgatggagagcaattacacatttgtccagaaactagatggctaagtctaagtctgtgctatgccgataggtgctatagtgatagaatgaaaggcccaatggaaatatttctatttgagacaataagttaaatttttaggttcagttttacattggaataaggcaaaaccttagatagcagagtctgactaaccagataagttaaccagcagcttgaaacttacaaataacttttacctttgtacttggttgattaaataagctaaaccggtaggttagcaaagaataatttttactttttccattcttctctgttcaaatgagatatattgaataattttttcttggcctctaaaagaaatttcagacagattatttggcttttttggtgatttccatataataaatgtcatctggtccttttcagccacaagaacagacctgtgtcaataattaaaaactcttgtcaaatgtaatgtcaaaactcaaaaaagttaatttagtccagaacttctttcctcttccttcccccaagtgtggctctaactcaacttggaaacgctgggatatgtgaggtgggggtagggaagagacagggaatgtctctgattccctgacttggcttcatcctctcctccgctcctagctgctggcttgggtccctctttatggggaatggcgtaagaagaagagggagaggtaggtaaggaaggaacttccttaataggctggatgtaatctgacttaggtgtcctctggatgaggagaataaaaattgccatattgacttcatggggcactctggcagatttttcagaaatccctgactgtcctatggctgctgtcccttggtgcaggccatgcctctcttctggtcttctgcttccttctctctgcagcctctaaacttctgaaggtcagctcctcttgggggcttctttgttcctctaggtgttcttcctgagtgagattcttttcatggcaccctattatgtctggaaaaatgtgcacctttgcctactctatgggggaagtgctcctcttcaccagtgtggccctgtctctcttctccatgcccattcagagccactaaccaaccatggactcctaatgcagcctctccagcctgagtaaggcaccatgcccctttgtcctaaattccaggacacacaggtcaagagatatgagtatttctctcagatccacacttcgcttggtctaaagtgaaggagcggattcttcttcatcttctccatgagggagggcctgatgcacaggacccttcaaaggaactcttagccagtctgctcccaccccgtcacacagctttgaggttgatgatggaccaccactgacaggtcccactccacactgcctcgcatgtcctgcataggtgggctagaaccctgctttcaacgtgaggtggcttgtgccctgtattatggttcttaacctttggaacctcatctgaaatgaaggtacaagtattccatttaaaaattttgttctgcattaaccattgaagagttaaaggaaatacagtgaaaatgaagcaaacatgatgaggtgatggttaacccactgagaggatccacagaaagctgtagttcttagcaatagtgtgatggatggaagataaacactgagttctagaagcattggccaaaggtgaggatgcttgaggaacatgaagggagacaggagaatgcagaaaagggaaagctttcacgtgggtggttccttcttctaagggtgattaaaagcaacagaagagactaagcaaacaaaataccttctatagcacttggttcacagtaagtgtcaacatgttgtattctattattagaacctctaaatccatttggaaatacagtaagaacccaaggtaggaaatagagtggctgattgaccagtctgtctttgtctaaggggtgtgtgtgtatgtgtgtgtctgcgtgcatgtgtgttttaataaaaataatctaggtttagaatgaaagcaaataatctaggtttagaattatgtatctacttgagatagatactgatgtaaacaaaaccaggctcacaaggaccaacatctagtgaggggaggagggaagtgggcagtaaagatgagcagaaatctacagttagcatgaaaagccacattataccctacttgatatatcccccacgactgccctctccctttctcttgctttgctcagccaagctagcctcctagctgtttcttcaacataccaggatttctctcatctcagggccttttaacctcacttcctatgcctgaaaaattcttcccccaaatatctacatggatcacaccctcatcttctcgaaatttttgttcaaatgtcaccttctcgatgaggtactccatgaccatcatattttaaattgcagctgcctcccaccccatttcctgttccccttttttggctgtattttctccataacacattttaacaccgtctataagttacctgtttggctcctctccacacataaaaaaagtaaatctgatgagggcagtgttttttatcttatttgtctactgatacagctgtatcacctagaacaatgataacacatggttaccaataagtattgataattcagtaaatattttttaaatggagaatttttttaagtataaaaaagaagagattaacaaaggaaggctttagggaatgcagaggatatctccctaaagaaaagccatctggctagggctgatgtctgggtagccttatgacaggaagctgaaaggtggtggtgggacaggaagctgaaaggtggtggtgggacaggaagagaagctatcaaaggcctgctattctgggtggttgcgtgctcgacatcatgagtgagctcttccgtggctaggccctgatgatgatgatgcatgctgcagcaaggctaactacacttataaggctaccagaatggaataaatatagtctttagtgtcagacagccttgggttcagttgttgtctctgccacctactggctctgtagcctagagcaagtcattctgatggcagcagctgcccgactggactagctgctgtggggatgccagctgtagtgagggaggcctggctgggactgttgagcccgtagaggctgagaacaggagggagcctgccccctactgacttggcaaggcaggagccctgggctttcagggcagctgcagccacccagctgtggctccagaccctgacacccctgctctcttgagggcctgggaacacccccgcttctgcaggctcagaagggcctgcttccaccccctggactcttcccactcccagcacctgctccaatttcagagcaaagatgaggctcagcccaggcactgtcacaacctggccaggtgtgtgcacacttggggcagcactgacacaccaatcccccaccttggccccctccagactttgggcgccaaggagcacaggaaggaggcagcaggtggagatgggctgagggcagctgggtgcaggcctgcaggtgccatttggtgcaaacagcctgggctatggaaggcatgatgacagtgggaggctgactaggttcctggatggaaaggtgtaggtccccagtgaaaccccaccttcaggccaggcatggcctgaagcctgggagccaggctgccagttccaagtgaagtccatggatatgagtaataacttcatcgatgaccactgggccaattggatagtgctttttcctggcctgcctatggccatctatggaccaatcaccatgcactttctcccttctgagcccatgaaaaaccggggattcagccagactcagaaagaagtcaagactaccagctgtgggagggagctacccactatgggtctcctcatccagacaacttgcctgcagaaaggagctacccactacaggtctcctctccactgagagctggacactcattgggacagcctgcatatggaaaggaactacccacttcaggtctcctgagagctgttctgtggctcagtgaagctcctctccaccttgctcaccctccagttgtcagcatacctcgttcttcttgggggcgagacaagaacttgggacctactgaatggtgggactgaaagagttgtaacacaaacccagctgaaacacacctcccacctgctcaccacattgcaagcaatgagaaggagagaagagctgtggcccttcagggagcccagacctaaggcctcccaggccagggctgtaaaaccctctttggagctctacagttcctggcatctccaagctttctggtgccacagtgttccccttgtccagacaccagtgcctgcagcagaaactgcttgccatacatctggtccagcagcagcatcacacagagtcggcacccatgctggagcctggagattcccaccctgcctcagcagccagtgtgcctggctgtgtgcagtggccagaccccacgctcactcgttcacacaccccttgctgctctgcacctggctcacccttggcaggtgtgggatccaggctggtagcacagaccaagcacagcctgccaaaccaagtgggtggaatgagcccagaagtgtgagcaatactcaggcagaaggtgccactggccacagaatttctggctggcaaagcaagacctcaaggatcccgtgacaatttcacctctgtagtagtttccttgtcttaaaaaaatgagagtaacattatctagttcatacaattattaggagaatcaaatgtgaaagtgcataaaaaacaacaatgaagctacgactcatactgtccagtttgagaagaaatgtcatgattaagagtctagtaagcaaaaaccatctcaaaataaatcaagacctttatatgtaatttttaattccttgaaggaggaaacaatgaccaaatttatttctctcttttttttttttttttttttgagacagagtctcgctctgttgcccaggctggagtacagtggcacgatctcagctcactgcaagctccgcctcccaggttcacgccattctcctgcctcagcctctcgagtagctgggactacatgtccagctaattttttgtatttttagtagagacgggggtttcaccgtgttagccaggatggtctcaatctcctgacctcatgatccacccgcctcaacctcccaaagtgctgggattacaggcatgagccactgcgcccggcctcgctttttttttaagttaccagcttattctttatgctccacttatgctactttgcaactgctcacttgcttcttttatttggcatatagtaggtccatattaaattatttttaaaatctatgttgtttggaaaatatttcagtatttcccaaaagttaatcaaccataggtcttctagccttcctctacctttcctttctctagcagttaggtcactaggaagactggcaagagtataggttaagagattcagttctgcttaatgatgtcacatggagatgaccagaattagctcttttagaacatgtttctgtctgcccactcaattcagcactgactggagctgtcttctaacttaattgaatttccagtgatagcataaaagggtgggttttttttattttagtgagaaaatttttaaagagttaaaatagaaatgagccaggaaggcttcaaacctcctcatgtaacctcatggccatttctgagctagtataaacaaaacattttgtgtgaagtagtgtttacctctaaatttcatcttatttcctggagacatgggtcattatagtgtaactctggatacttgcaagatttgataataataaacattcacattgaagaaggaataaacaatcagcaaacaaagccatcaactccctatcacagagtttgtcatcttacttgcctacatagtatctcatgatttagaacacactattgaatattgaagagattttgctatgttgtgaaatataaacttagccttaaaacaaaaggtacaaagcaagctttctcacatctggaaatatatgatcaatatgaatctttcaaaaacatggctatgaggaatgcaaataaaattttttaattctctgcatgatatcaagagacagtcagacatgttcttatatagttacagaatctccaggtcaggttctaagaagggattttttaaaacaaaacaaaactcctaagaaataagcagtgttgctgcacactgtgccacagtttggtcactgttctcctgctgcttttgtcttggatatgcactttggcaggtaacgccccacctagctctcacatccagttcaactcagcacatggaaaaaacacccctgagggcttgtaaaagcccagccctggaatggacaggtgccagacatggctattactaatccatgacatgtgagaccacacactgggcttttgcatggctatgccctctgcctgaaagctcccaccctccctccgctggccacaatctcccactaaattccttgggaaagctttcctgggattctgactgggctacccctgctttaatatgttctagcatttgaattggcttatgtgatcgtctggttgatgtccatctccttcatgaacttaaactccaggagagcagtattcccagtgccaagcacagtgcctgaaatttagagactctcaaatgttggttaaacaaacaaaaaaaatgtatgcagggagtatcaagagaggactatgtgaaggtttttagagatcaggtcatggaatgtgaaggggccttaaccttgaaccacagtgtaaagtgggagagagaggggtagatttaatttatctaggaactacatagttctctaaaagactttaactctgacttctacataatgagtgaggtcccatagtaaaggggtcattatcccaataacctgtcaagttggttcagaccctcaagtgaaagtctaaagaaaattcagctggagaccaataggagcgaaataactttgtgctccctggggaaagagactaggagactaggtatcattgatctttttgttccccacacttggcatgtattcagccctcaatgtactccacagcactgtgtgtgagaagggtaaagcaacatagatgtctaagttggggcagagacatagtcacacaaggattaaggcagcatgcatccctgaggcatgtttctcccccaacaaggtccctaaataacataataggtagaatcaaatgagtgagttctccttctcctgcagtaacccttgagaaatgatttatgtcacattattttctgacctccagaagagaacatttaatcagtcattttaatataaatgaaattcccaatcaagttatacttcatcaggattcctgtgattcctgccagaattaaatcacatgtcctggtcagtgccagcacccagtgtgggcaaccaggctggcataggaaagtgtctgttgcttgcaggtaagatatatttttaaaggctgctggcagttgcttattagactgagatttctaggtagtggtcatgtagtttacaaataaatattaagttctttgatgtttatttcctagatctttttcatcatcctcattatgacaattgttatcatagcaccactgttaagaacaattcctttgaatttacttaccaagtctctcagcaaatacttttggaggttaattctcagcatgagagagagaaggtaggggaggaaggaggaaagaaccatctttattcattaggaagagcctatcatatctctcagtatctcacagtgttcaaattacttatacctaatttatttattttcttctatataatttttaccttgtcttgtcccaaaaggaatatgaagtaactttaaaaatacataacaatacagaattttgaaaagaggtaactgaaggaattgctgcagagagaacaaaagcaaagtcttcttaatgacagaaataaaattataaatcacttggtgatccataggtttgtaaaatggtataacaaggcagttgtccagaagcacagccgctcttaatgcagagactgcctgggccctcctctagagggcgtggtggagcacagtcccagggactttctcactgcaagtgaacaatggcgacccctccccgcatcgtattagactgtcatctagtgtcagccaatgggaaaatcctcagtactatataagagcaattccacagtgactaggaatgtagttccaatactcagttcaaagcaatctacaaaagcatcatatatgctttaggtagtcaatcttgtgcaatttttctattaatacagcctttgatgaatggtgggaggcagtgagctagaagttacaattaccgcacaagaatctggtactgatggctcagtgggatggcagaggagaagaattgtaggtgattctgccagtgagaagttattaccctaccacaaagctaatgccccagcctactatcacactctgtatttctgactattagcccttttctagtgcaacactttggaatgtagttcttgacttgggccaggcctggggaagaaagaattagttaccttagatcaactttcttccagaaagaccaaggtaaatggggtaattgtggaactcctcaggagattcaagtggcctatagttagaatatgcttgtattatcaacatctgctaaactgcaagtgacctattttacagattctaagacatactttttagcatttactacatgtcaggcactcttctaagtattttatatgtatgactcttttaatcatgaagccacggtgtgtaagtatctttttgtagttcattgataggctgcattgcaaaaaaaggttatcattgatgacctctggatgtgaactacttataaatgcattaaccacaatgccaacttattcatttgatttgattgcccatgttctctatttaaggcatgtcctttcacataactgaggtaccaggaaagctggctgccattcactaccaactaaagcttgaggatgaatgaacatactggctatcatactgtaatgatattttataggatactttacacaattatacagcattctttttatgaagatctggggaaaagtttctttttaatcacaacaaaaagaataactatttctctagctattcataataatactgtttttatcttattatattcatcaagcacataacctatactctttatttcttagcacttcctaccagaaaggtcagaccaaatgtggggcccacatctactaagagcataagacatcaggaaatgcactttgtccactatccctgtttaggtttcaacaggactcaacataatttttctactgtattttccttgttcctattttgcctttctgcttttatcttcttgtattgcacattgatataaaccaccttaaatacattttggaccaaaagagaaatgcacacaaaatgtatttaaaatttttatttccaagagatataaacctgatttcaatggactgttgttggatattcttctttaatctaccttgctttatataatagttctaaaatatagagctattttcaaatgaatatgaatcagtctttcattttgggggagtgagggggaaggaagagaatgtaacaattatggagtataaagatggagaaatgactttgcaaactaacaattgaagtaaatatgaaaccatatttagcatgtgaagatacggttttcacagtagtatttgtgaaaattcactataaggtaagtttcatgagagcagggaccctgtcttcattgtttattactatatccccagcgtgcagaatagagtctggcatacagtagacactgaaataatatattttgaaagtatgaatataatacatttagaattaggaaaccgggttaatagcaaagaaatgatattggatattgattatttaaccacaagcatattccttttggattcggtttcatcatttataaaatgaggctgttcactaagattctttccaactctaatattccaggctcttgttaaatgtagtggcacagttaaacatacgaatgtaaatacatataataatttgggaattttattttcaaaataggatatccagctacatcttcagtgacccttgtagatgtgagtgccttgaggccaaacaccactcctcaacgtgagttcagcaaagttttcctacatgattggaaagagacaacacactcacaagttttactactgcttctataatgttgacgtttcagcaaacagctgtatttttcatttgatgtttgttaatatcttggttttgggttactctgcggtgactatatattgatatgacaatttctataatcttaaaaaataagggctggtgatttattatattgtatcttttatttgtcaagggattttaaggtaatattaaagtagtcttcacaatactctcagtgatctgagtttgtgacaagaacagaaaaagaacacaaatcagtgacaagctggcattaaacataaactacagagcttttgcttaatatgccagctagtgttcctgcatagggaagcacattttcaatttcagatttccccaaagtcacatagattaaaaattctgtgcatcaaagcaaagttaaattacagctttcgaaaaaagctggattctgaaaataattttgtctttcagccagcaattccagtatgactacccgaggcttcaactatccctggacctccagtgggacagataccaaaaaatgttaagtataatcgtgggtcccttgagtcctctggacttcagtcattcatccgacagatatattgaacgacatctatgtgctttgtttgtaataatatttgcaaatgttcacaaagcatctatcatgtttaaagtattgttgtagattctgagactacacccatggacaaaagagatctaagctccaaattctgattaaggggagacagacaagtggtgataagttatatgaaaaaaaggcacaggagggagacagtgggaatcgagagtgaagggttgccattttaaatgggcagtcttgaaaggtcttactgaggaaggtgacatctgagcaatgctataaccagtcaacccgaaagagcaagctgtgaatatatttggggaaagagcaaactagctagaaaatgcgtatcagtaataaaaatgaaaagagagagaccaacgtgagtccagaaattgtttcattcttccttttaatctggccaactagcagtagagtctgtaagtgctgctttagcagatacagacaggatctgaagaagaaatatattgcctcttagtggtattagacaacgatcagtgtggtggggaagtggtaaggaaggaggctggagcaaaaggagagaggacgatggatgccacagggccagaactctgaatttaaatgttagactctttgccacaaagcgtaatgtgtatgtccctttggaaagcatttaagttttacagttaaaacctttaaaaatatttcatatactcttgctccctcattcctgggaacttgtccttaggcaagaaagagagaaaaagaacatgaataggactgctctttgtagcattgtttatttattttatctttttgatggccctcaggctcacagatttgaattaatcataatatttaattcatgagacactttcatcattggtcgatgcatgaccctctgtaatttaacatatttcttttaataaatatgttaatgtaatagacacccatgaacccagtacccaaatataagaattgaaaagacagtattcagaagggggagcatagaaagaaatctaaaaataaatggaacttaagtgtctatcaaagatggtgtggcagattactgtgaaaagaggagactgttcagcaaaaggatctagaaatagtgattattgataagaaaaaaaattaaaatgtacccctgccatgcacattacacaaaaataactctatatagtttaagatctttatgtcaaaagcaaaacattaaaacatggaataaaataaatgtggatttcctcctgctttggagtagggaagggcttaacaaagagacataaccataaaaaatatgtaaaaattagaataaaattaagaaacttgggttcatcaaaagacgtctttaaaaagtaaaacaaaaagcaagctataatctggggaacatatttgccacacatataattgaaaatgaatcaggaatatataattgactaaggatcaaaattttacatcaagagattacaaagaatgcctacaaattaataacaaatatgacaaaataaacaaaagtcacaccacaaaacatgaaacacacgtggctagaaacatctaaagaaatgctcaatctcggccgggtgcagtggctcacgcctgtaatcccagcactttgggaggctgaggcgggtggatcacgaggtcaggagatcaagaccatcctggctaacagtgaagccccatctctactgaaaatacaaaaaattagccaggcgtggtggtgggcacctgtagtcctagctactcgggaggctgaggcaggagaatggtgtgaacccgggaggcggagctcgcagtgagccaagatcgagattgcgccactgcactccagcctgggtgacagagtaagactccgtctcaaaaaaaaaaaaaaaaaaaaaagaaatgctcagtgtctctggtaatcaggaaatataaatgaagactagaattagaaaatcattttatatgtaatcagtttacaaaaattaagaaatctgatattgccaactattgaataggatttatccagcatcctttcaacataatttcttatatgttactggtggtaccatcactttccaccatcctttggcattgtatttcaaagctgaatatgtgcatacctacaatccaacaattctattcctagatataaaaatccctccaaaattagtacatctatgcatgagatatgcacacaaatgtttggaggaaacactgttcatatagcaaaaactttaagtaatctaaatggccatagtcaggaggacagataaataaattgtagtatactaataaaatataatattaaagagcaatgaaaaacaagtgaatggcaaccatatacaacagcatgaatgaatcttaataacattatgttgaattaaaaagtaaataccaaataacaacatatggcatattttctaatgaaattttaaagcaagtataaacaccatatgccttagacgtaatatgtgatataaaattttaagctttataagtgaataataattataaacattcaggacagcatttgcttttgatggagatataagggatgagacagggagaaaacatgtataaatctgtgtacatgagtaggagtgagagggtattaagagggtgaaaaatatgttcagtaataagaaatggcaaataggatgagataactcaatgaaatactatgaagccagccaaaacaatagccataaccctgatccgttcttcttcactgggcaggacctcacagctggggcctccagccaccccaccagctgtattctatggacagaactctgatgtctccttgggacagagtgccttgtgggaggggtgggccatcaccttggttgtttggatgactcagcccttccagcctgtaggcactggaaagtccaaacggaacagagcagaggcagttccacaacacagttccccagcacagctgttttgttaaggaatgaccagactgcttctttaaacagacccagatccattcctcctcactgggagggtcctcccagccagggcctctggccagccccacccatgttctatggccaacagagttctaatttcttcctgggacagagtgcccagtgggtgaggcagacatttgctgtttgggcatctcatccagttcaggctgtgggccttgaagagcccaaatcaattgggtgctgaagagatctccaacatagcacagctgctctaccaaaatgcagccagactgcatctttaagcaggtccctgattccattcctcttgactgggtgagatcttccaactggaatctccaaccacctcctacaggcacggtcaggccagcaacaggtcagtacccccctgggacagagctttcagaggaataggcaggtggccatatttgctgtttcacaaccttcactgatgatacctccaggtactggaaaaaccaatgtgactagggtctggggtagacccgtagcaaaccacagtagccctacagaagagtgcccagactagtcgttcaaagaaaacaaataaaacacaacagcaacaacaaaacaaaaaaaccatccaaaggtcagcaaactcaaagatcaaaggcagataagcccacaaagatgagaaagaattagcacaaaaacactgaaaactttaaaaaaagaaaaagaaaaagaaaaaaaacaacaaccagaatgctccctttcctccaaataatctcaacacctgcccagcaatggttcagatctgggctaaggctgagatcactgaaatgacagaagtagccttcagaatatggataaaaatgaagttcactgagctaaaggagcacattgtaacccaatgcaaagaagctaagaatcatgataaaacaatgcaggagttgacagcctaaatagccagtacagagaggaacataaccaatctgatagagctgaaaaacacactacaaaaacttcacaatgcaatcacaagctttaatagcagaatagaccaagtggaggcaagaatctcagagcttgaagattgtctttctgaaataagacaggccaacaaaaacagaaaacagagtgaaaaaaatgaacaaaacatttgagaaacaggggattatgcaatgagactgaatctatgactgattggggtacctgaaagagacaagaatggaaccaacttggaaaacataccatccaggagaacttcaccaacctagcaatacaagccaacattaatttcaggaaatacagagaaccccagtaagatactccatgagaagatcattcccaagacacataatcgtcagattctccaaggtcaaaatgaaagaaaaaaatggtaagggcaggcagagaaaaaggccaggtcacctacaaaggggaagcccatcagactaacagtggacctctcagcagaaatcccacaatccagaagagattgggagcctacattcaacatacataaaaaagaattttcaacccagaatttcatatctggccaaactaagcttcatacataaggaagaaataatatccttttcagacaagcaaatgctgagagaatgcattaccaccagatctgctttagaagaggtcctgaaggaagcactaaaaatggaaaggaaagaccattaccagccactacaaaaaaacgctgaagtatacaggccattgacattatgaagcaaccatataaacaagtctgaaaaataaccagctagcatcatgattacaggatcaaatccacacacagcaatattaattgtaaatgtaaatgggctaaatgccccaattaaaagacacagaatggcaagctggataaagaaccaagacctgtcagtatgctgtcttcaagagacccatctcacatgcaaagacacacagaggctcaaaataaagggatggagggaaatttgccaaacaaatggaaaacaggaaaaagcagaggttgcagtcttagtctctgacaaagcatactttaaaccaacaaagataaaaaaaaaagacaaagaagagcattacataatggtaaatggttcaattcaacaagaagacctaattgtcctaaacatatatgcacacatacaggagcactcagattcataaagaaagttcttagagaccctcaaagagacttagactctcatgcaataatagtgggagactttaacaccccagtgaaaatattagacagatcatcaaggcaaaaatcaacaaagacattcaggacttgaactcagctctggatcaagttgacctgatagatatctacagaactctttacccaaaaacaacagaatatatacattcttctcatcacctcatggcacttcctctaaaatttatcacataatcagaaacaaaacactcctcagtaaatgcaaaagaatggaaatcataacaaagtctctcagaccacagcacaatcaaatgagaactcaagattaagaaattcactcaaaaccatacaactacataaaaattgaacaacctgctcctgaatgactttcaggttaataatgaaattaaggcagaaatcaagaagttctttgaaaccaagaacaacaatacaatgtaccagaatctctgggacacagctaaagcagtgctaagaaggaaatcgatagcactaaatgctcacatcaaaaagctagaaaaatctcaagttaacaactaacatcacaactaaaagaactagagaaccaggagcaaacaaaccccaaagctagcagaagacaagaaataaccaagattggaactgaaatgaaggagatagacacacaaaaaacctttcaataaatcagccaatctaggagctggttttttaaaaaagattaatatgataaatataccactagctagactaataagaagaaaagcgagaagaatcaaacacaatcagaaattataagagggatattaccactgaccccacagaaatacaaacaatcgttagagaaaagtataaacacctctctgcaaataaactaaaaaatctagaagaaatagataagttcctgggcatatacaccctccaaagactgaaccaggaagaaactgaatccctgaatagaccaataacaagttctgaaattgagacagtaattaatagcctactaaccaaaaaaatcccaggattatatggattcacaactggattctaccagaggaacaaagaagaactggtaccattcctactgaaaccattctaaaaaatttaaaagaaggaaatgcttcctaactcattccatgaggccagcatcatcctgataccaaaacctggcagagatacaacaaaaaaagaaaacttcagaccaatatccttgatgaacatcaatgcaaaaatcctcaacaaaatactagcaaaccaaactcagcagcacatcaaaaagcttatccaccatgatcaagttggcttcattcccaggattcaaggctggttctacatacactaattaataaatgtgattcatcacataaacagaactaaagacagaaaccacatgattatctcaaaagatgcagaaaaggccttcagtaaaatttaacatcttaaaaactctcaataaactaaggattgaaagaacatacctcaaaataataagaaccatatatgacaaacccacagccaatatcatgctgaatgggcaaaatctggtagcattccccttgaaaaccggtacagggttgccctctctcagcgtttctattcaacatagtattggaagttctggccagggcagccaggcaagagaaagaaataaagcacatttaaataggaaataaaggaagttgaactatctttgtttgcagatgacatgattctatatctagaaaatcacattttctcagcccaaaacttcttaagctgataagcaacttcagcaaaatctcaggatacaaaatgaatgtgcaaaaattgctagcaatcctatacaccaacaacaggcaagctgacagccaaatcatgaatgaattcccattcacaattaccacaaaaaagaataaaatacctaggagtacagctaacaaaggaagtgaagagcctcttcaagaactacaagccactgctcaaagaaatcagagatgacacaaatgcaaaaacattccatgcacatgggtaggaagaatcagtatcatgaaaatgcccatactgtccaaagcaatttatagattcaatgctatttccattaaactaccattgacattcttcacagaactggaaaaaaaaaaaactattttaaaagagcccaaatagccaaggcaacccaaagcaaaaagaacaaagctggaggcatcatgctacccaacttcaaactatactgcagggctatagtaaccaaaacagcattgtactggtacaagaacacacacatagacgaatagaacagaatagagaacccagaaataagactacacacctacaactatctgatctttgacaaacctgacaaaaacaagcaatgagaaaaggattccctatttaataaattgtgctgggagaaatggctagccatatgcagaaaacttaaactggaccccttccttacaccatatacaaaaatcagttcaagatggattaaagacttaaacccaaaactataaaaaccctagaagaaaagctaggctataccattcaggatataggacgggcaaagatttcatgatgaagatgccaaaagcaattgcaacaaaaacaaaaattgacaaatgggacttaattaaactaagaagcttatgcacagcaaaagaaactatcaacagagtaaacagacaacctacagaatgggataaaatttttgccatctatccatctgaaaaaggtataatagccagcatctataaataccttaaactaatttacaagcaaaaaacaaacaaccccattaaaaagtgggcaaaggacatgaacagacagttctcaaaagaagacatacatgtggccagaaacatgaaaaaaaagctcaacatcactgatcattagagaaatgcaaatcgaaaccgcaatgagataccatctcacaccagtcagaatgtctattactaaatagtcaaaaaacaacagatgctgatgagggtgtggagaaaaaggaatgcttttatactgctggtggaagtgtaaattagttcaacattgtggaagacattgtggcgattcctcaaagacctagatgcagaaatatcattcgacccagcaatcccattactgagtgtatacccaaaggaatataaatcattctattattcaagacacatgcaagggtatgttcattgcagcactattcacaatagcaaagacatggaatcaacctaaatgcccatcaataatagactggataaagaaaatgtaatacatatacaccatgcaatactatacagtcataaaaaggaatgagatcatgtcctttgcagggacatggatggagttggaatctgttattttcagcaaactaatgcaggaataaaaagccaaacaccacatgttctcgaattttctccatgtcagcagtgttatcatttatgtgttcactgaggtggcacttttagttgccttcaataactttttctttgcattcacaacttggctaacaatttggcccaaaaggcctagctttgagcccatctcagcttttgacgtaccttcctcactaagcttaattatttctagcatttgatttaaagtgagaaaagtgcttctcttcctttcctttgaatacttagaggctgttttaggattattaattggcctaatttcaatattgttttgtctcagattaaaaaaaaaaggcccaaggagaggaagagggatgggggaaccaccagcaagtgaagcagttagaacacacacaacatttatcaattaagttctccatcttctacgggtgcagtttgtgatgcctcaaaataatttcaatggtaacatttaagatccctgatcacagattaccatagtagatataacaataatatgaaagtttggaatattgcaagaattaccaaaatgtggcacaaagacatgaattgagcacatgctgttggaaaaaaaatggcacctatagacttgcttgacacagggttgccacaaagctacaatttgtaaaaaaataaaaataaaaaaaacaaatgcagtatctgtgtctgtgatacagatacatggtcaggcacgcctgcaccaatttctgggggcttcatgggtttccccatggttaaggcataagccccatacttccaaagcttgtgaatgtcatctttgtcagcaagagtatgagggccacatttgtggaccaggtggacatggcaaaactgggcacagaagctagcatcagtgtgtgcatcctggcggcagaggtggtgctggcccagtacatattcaccttgaaaaggaagatgagatgaaaaatcaagatcatcaaaattcctgtgtccaggccttgtatctccggatattgtttgccacctatactgttgttcaaggacaaaatcgaaaacagaagaactcagaatgccttaaggagtattgaatagctaagaagttgctcatcaaaagtctgctgtgcatgtaaaaatgatgcaagaattccagaaaagttcagtttgcatcaagaaccctgcaaaaataacaaattatctgtggttttattaaaggaagatgccaaactttagtaataatggactttgatatgacactaagtagattttcctaccaagggaaaagatgcctaatgtgtcataatatgattgacaactataaacttgtcacaggtgaatgtcaaagaggttattgcaactaaaggaaaaatattttattattgaagttgaacctgttaacttcaagagaagtacccatttatggtagaatagtatgctgcccatcaatagtgtctttgttgaacaaactttaccaaaaaatgaaatttaaagaaatcgtggaagaatctgatgttatgctcaaggaaggatataataatttacttgagaagctccaataacacagtattcatgttcatattttcagcagatactggtgctgtagagaagtttatcagtcaagctggtgtttatcatccaaatgtcaaagtagtgtttgtttgtagatttgtgaaaatgtgtactcaaaggatttaaaggagaattacctcatgcagttaacgaacataatgttgccttgaagtacacagaacatttcagtcaattaaaagacaatagcgacagggcacggtggctcacgcctgtaattccagcactttgggaggctgagtcaggtggatcacctgaggtcagaagtttgagaccagcctgaccagagtggagaaaccccgtctctactaaaaatacaaaattagccaggcatggtggcacatacctgtaatcccagcttcttgagaggctgagatgggagaatcacttgaacccgggaggcagaggttgcagtgagtgcgattgcgccattgcactccaacctgggtaacaagagaaaaactctgtctcaaaaaaaaaaaaatagacaatagtaacataattctgctgagactcccaagaagactttaaaagggcatacaaattagccaaattttcacattctgaaaattagatccctaaatgatagagtggataagcattcaggaaagtattgtttcatcaaaagatgaatcactagaagtagccaactccatcttacagacgattctataaacaagcattcttcaggatgttctctcctgcaggagcaagagataccagaattgttcatctcttcatcttgctgaaaggctattttttataatatctttctggtcttgaaagtttacctttatgtatttaagtgttttcagacatgtggaatccatcaacgggaaactccattttcttcacctctctcaccatacttcccactacatgttattaacagattaaaaacaaaacaaaaaacctcaaagtcaaaattagaaaaataactccctacttttccaaagtggcttatgttttttaattttttaattattttgaggggtcttttaaaattgggaaagttagtagaagtccaaaaagaagtttcatgaaattacaaaaagaaaatggcataattttaagtgttgtaatgtttgtaatttgtaattgtgctgatggtatcaccatctcctgaaatcgtgttatgttaggctattttgcttggggaaaatcaatattgaccagaaaagcctggcactgtatacttgctgaaaactattagtgtccacacatcattaaccattacaaaatgttctatattgactcactgataataaacatgaaatggaaaatatttttaaatacccattttccttaaatggattgtgcttattcagccatttagactttagcgtaaattaatttatcccattctttcttgcaaacatactttgatgagatacaaaataaagacatcaaggtcagaaagtaagaaaggagtcaccataccatattgagcaaaaaactacaaggttattcagaacaaacttccttcttcataattttacctaaatctaggcctagtcccaattgtttttcagttagttattgctctttggaaatcaaattccggcgaatggcataatcattaaaaaattcttagtccatcatcatcaatagaccttgatattctgtctagaacaaaaattaatatgcagtatcagagagttatattgaaaataagaacagctccctgaactcagactgaaaaaaagctgtgtatgaaaccactcttacttctcaggtgaccccaaatggaaatagctatgacaaattgtcctgtaatcaagccctaaagaatggactcttacctcttctggagggcctgatcacacacctttgtcagcaactgcagctgctgttgacatctaagaagaaacaaggaaagcggagggctgagggtattgtttgttttattttgattttgctcacttgatttggtcttggcacacaagaaagcttttaactatgaacatcatttatgctaatattttaaatgaatggatgtaatatatttgtactgattacaaccgtgtattactatagttattttactttacattgcactgcaggccttttatcaaatacagatatgtggtgtctgccaaggagtgactctttcttgccagagatggggcaataaacaaaatgagttgttagatctatttcaaaagccatatgtgctgtctgagtttgctgccatccactcaaggggaaggtttgtctctaaatgcttcaaaaggactcactcagcagctgacaaggcctgtgaccccaggggtctgataattcactgctgacatgttttgttttcacagttcagcaagactgtcagctgacccacaagtacaaagtgttttcgtcccctatgcatgttctagcaaggtcttcaaagtcctattggcagcttttcttgactaaacgccgccataacacacctggaccttcattctcttccattttttttttggctcatctatggaatgagcatgacacactctggctagaggaaccccttctagtgttttctttccatatcttttcctgcttctaagtggccataattaaaaccttccccattatagacatctgaaccacaagaatcccttcaactcccactttgtttgaggacattcttgtgtatgctatggaacagtttaatgattttgctttatgtactcattaatatccttttttataattattagattaaattagcagtcaagaagtggtaatatagtctcatataggttaactcttctgatatcttcttcctttagcagtttcacggatacctagtgaaacatacagttcatccccctcaggtgcaggctcaacacttcatggtgagtacttggggaagatttagggacactgaagctagtggtcagctttatttggacacaggtgtaaaaacaagaactgataagaagccagcctcagatagatatataaaagtacatcttgatgatgaaaattacaatgaatggaaacaaaattcttctcagccattcaaagaagatagagaccaagccttagatttttatacattttatttccaaaaaaatctacacaatagcattttttactagttatatctatgaaaaataaatttcaatttttttattggaaaatagaataattagtcaacatggatttgtctagtctaatgttgcaaatgaatttttattaaccttatcaaacacatcggtgtggagagaaattagtattttgatcagctgaacctctcataccaagagaacaggaacagagcctcacttatccacgacccccaactctggcctttttctgtaccacttacatttctcatggagattctttagcagacatcattttgttgtttggaagtatggagcttctttttttttttttcaaccaataggaaattttcctattttcaaccaacaggaatttttttttcaaccactaggaaattttattcctttggcaattgttagacaaatctcaggatcccagccttgctataaattggttcttaataaactttacacataatatttaagggatacttagacaatttaaattgagttctttcaaataacatatgaaacccaatcatggttttataccacttgatcaagttgagatgtcttgtccagatatcccctttatatccctagacaatgtctttaccagcacagccagagcattttcagaagtccccacaactgccaatggatctacgaaaactaatcacgtccatatcactggtaagtcatttatcctattttgggggattttatgctttattcactcaataaatatttatcaagtacctgccatttgccaggcattatgccagttgttggatatacagtgaacacactggctttttgaagattataatctattagtgatcgatcatgtgtatagtaaataaataatcacaactaaatttattttgacaagtactatgataaggtgttgtcagggtcaaacaggaagttctgattttaattggaggataggagaggactctgtgaggatatacttaaattaatatctgagaaaaataaataagaatttattcttgttgaataaattgaaaagtagcaaaaagcatttcaagcctatgaaaacatagtctgagaaagaaatcattggaacaaagagtactcctataattcaactaatataatattgtcatgcaaaatgtaatccctcttttatatcataagagagcaaaagattcaataaagttaggaccctcctaatgaaggtcatgattgtaagttcacaggcataatcaacttcaggggtgttcacttgactagtgaatgccacacctaggtactcagctcattttgtgtcaaaggtcatacagtcttctgatcattggagcatcatcttgcacacgtcgtggcaataaagctgcaaactgaggcactacaaagattttaatatattggtgccttaaagagctgtctagtttagagatgggtcaaaaatggagttctgtttttccacttccattgtgaaggcagtggtctcattttctacacttggttggaaaaaaaaatataggcattgatgtaagacctctttaaaatattttgtttggcaagaatgagggatcatggcagacaggaagcaggactagattgcaactctgcagcatgcagagtcttcattgtgaattttagctccagatcaactgcaagaacaaaccagcaatcctgagaaaacccacagaccctctgaaggaagcagacagcctctgtagcacccaggagacaccccaaatactctgggaggtggatagcctcacaaattttcaagcccatctcgccctccacctggagacagactcggggctgttggcggggtggggggcatggtgggagtgagaatggcctgtcagtttgtgtaggagttcggtgaggcctgtgactgccggctttcccccctctttcctgacaacctgcatgattcagcaaaggcagtcataattctcctaggtgcacaactccagtgacctgggaatctcacccccatccccaacagcagtggcagcaagacctgcccaagaagaatctgagctcagacatgcctagccctgccccgacctgatggtccttccctatccaacctggtagtgaaagacaaagggcatataatcttgggagttctaaggccccgcccaccaccagtccctctccagactactatagctgatgctttctggagagctctacctcctggcaggaggccaaccagcacaaaaacaaagcattaaaccaccaaaggtaaggaccctcacagagtccattgcaccctctgccacctccaccaaaacaggcactggtatccatggctgagagacccatagatggttcatatcacaggactctatgcagacaacctccagtaccagcctccagccaggcagactcactgggtggctagacccagaggagagacaacaatcactgccgttcggctcacaggaagccacatccataggaaaagggggagcgtctacatcaagggaacacccagtgggacaaaataatctcaacaacagccttcagccctagaccttccctctgacagaggctgcccaaatgagaaggaaccagaaaaccaaccctggtaatatgacaaaacaaggctcttcaacaccccccaaaacaatcatcctagttcaccagcaatggatccaaaccaagaagaaatccctgatttacctgagaaagaattcaggagattagttatttaagctaatcagagagggaccagagaaaggcgaagcccaatccaaagaaatccaaaaaaaatgacacaagaagtgaagggagaaatattcatggaaatagatagcttaaagaaaaaaaacaatcaaaagttcaggaaactttagacacacttttagaaatgtgaaatgctctcaaaagtctcagtgatagaattgaacaaatagaagaaagaaattcagagctcaaaagcaagatcttcaaattaactctgtccaacaaagacaaagaaaaaagaataagaaaatatgaacaaagcacccaaaagtctgggattatgttaaacaaccaaacttatgaataattggtgtaccagaggaagaaaagaattctaaaagcctggaaaacatatttgggggataatcaaggaaaacttccccagcctcgtgacagccctagatgtgcaaatacaagaagcacaaagaacacctgggaaattcattgcaaaaagatctttgccgaggcacattgtcattaggttatccaaagttaagacaaaggacagaatcttaagagctgtgagacagaagcaccaggtaacctatagaggaaaatctatcagattaacaacagatttctcagcagaaatcctacaagctagaagagactggggacctatcttgaacctcctcaaacaaaagaatttttagccaagaattttgtgtccaatgaagctaagcatcatatatgaaggaaagatacagttgttttcacacaaacaaatcctgggagaattttaccaaaccaccactacaggaactgctaaaaggagctctaaatcttgaaacaaatcctggaaacacatcaaaatgaacctgtttatgcataaatcacacaggacctatgaaacaaaaatacaagttaaaaagcaaaaacaaaaatccaaagtacacagataacaaagagcaagatgaaagcaatggtacctcatatttcaatactaatactgaatgtaaatggcctaaatgttccacttaatagatacagaacagcagaatggataagaacttacccatcaactatttgctgccttcgggagactcacctaacacataaggactcatataaacttaaagtaaaggggtggaaaaaggcatttcatgccaatggacaccaaaagcgagcaggggtagctattctcatatcagacaaaacaaactttaaagcaacagtggttaaaaaagacaaagaggacagtatataatggtaaaaggccttgtctaacaggaaaatatcacaattctaaacatacatccacctaatattggagctcccaaatttataaaacaattactaatagacctaagaaatgagatagacagcaacaaaataatagtgggggacttcaatactccactgacaacactagacaggtcatcaaaaccaaaaatcaacaaagaaacaatggatttaaactataccttgaaacaaatggacttaacagatatatacagaacatttcatccaacaactgccgaatacacactctattcaacagtgcatggaactttctccaagatagaccatatgataggccataaaatgagcttcaataaatttaagaaaactgaaattatatcaagcactctctcagaccacagtgaaataaaactggaaatcaactccagaaggaaccttcaaaaccacgcaaatacacgaaaattaaataacctgctcctgaatgagcattgggtcaaaaatgaaatcaagatggaaatttaaaaattcttcgaactgaatgacagtaatgacacaacctatcgaacctctgggatacagcaaaggtggtgctaagaggaaagttcacagccctaaacacctacaacaaaaatctgaaagagtgcaaacagacaatctaaggtcacacctcaaggaactagagaaacaagaacaaactgaaccgaaatccatcagtagaaaggaaatagccaagatcagagcacaatacaattgaaacaacaacaacaaaaatgcaaaagataaatgaaacaaaaactagttctttgaaaaggtaaataaaattgaaagaccattagtgagattaaccaagaaaagaagagagaaaatccaaataacctaattaagaaatgaaatgggagatattacaactgacaccacagaaatacagaagatcattcaaggctattgtgaacccctttatgcacataaactagaaaacctagaagagatggataaatttctggaaaaatacaacccacccagcttaaatcaggaaaaattagataccctaaacagaccaataagaagcagcgagattgaaatggcaatttaaaaattaccaacaagggctgagcgcagtggctcagtggctcatgcctgtaatcccagcactttgggaggctgaagccagtggatcatgaggtcaagagttcacgacccgcctggccaagacagtgaaaacccgtctctactaaaaatacaaaaatcagccaggtatggtggcaggcgcctataatcccagctacttgggaggctgaggtgggagatttgcttgagtctgggtggcagaggttgcagtgagcagagattgtgccattgcactccagcctgggtgacaaactgagactccgcctaaaaaaaaaataaataaataaaagaaaaattaccgacaaaacaaagtccaggcccagatggattaacagcagaattctaccagacattcaaaaaagaattggtaccaatcctattgacactatccacaagatagagaaagaaggaatcctccctaattcattctgtgaagccagcatcaccctaacaccaaaaccaggaaaggacataaccaaaaaagaaaactacagacctatatccttgctgaacatagatgccaaaatccttaaaaaaaaaaaaaaaaaaaactagctaaccaaattcaacaacatatcaaaaggataatccaccttgatcaagtgagtttcataccagggatgcagggatggtttaacatacacaagccgataaatgtgatacaccacataaacagaattaaaaacaaaaatcacatgatcatctcaattgatacaaaaaaaaattcaacaaaatccaacatccctttatgattaaaactcagcaaaattggcacacaagggacataccttaatgtaataaaaaccatctatgacaaacccacagccaacacaatactgaatggggaaaagatgaaagcattccctcttagaactagggcaaaacaagaatgcccactctcaccactcctcttcaatgtagtactggaagtcctagccaaagcaatcagacaagagaaagaaataaagggcatctaaatcagtaaagaggaagtcaaactgtcactgtttgctgatgatgactgtttaccttgaaaaccctaaggactcctctagaaagctcctagaactgataaaagaattcagcaaagtttccgaatacaagattaatgtacacaaatcagtagctcatctatacaccaacagcaaccaagcagagaatcaaatcaagaactcaaccccttttacaatagctgcaaaaaaaaaaaaaaaaaatgaaatacttaggaatatcctaacaaaggagtctaaattcctctaaaagaaaaactacaaaacactgctgagataaatcatagatgacacaaacaaatggaaacacatcccatgctcatggatgggtataatcaatattgtgaaaattaccatactgccaaaagcaatttagaaattcaatgcaatacccatcagaataccaccatcattctttgcagaattagaaaaaacaatcctaaaattcatatggaaccaaaaaagagcccacataaccaaagcaagactaagcaaaaagaacaaatctggaggcatcacatacctgatttccaactatactataaagccatagtcatcaaaacagcatgctactggtataaaatacgcacatagaccaatggaacagaataagcccaaatacttacagccaactgatcttcaacaaagcaaacaaaaacataaagtggggaaaggacacccttttcaataaatggtgctgggataattgtctagccacatgtaggagaattaaactggatcctcatcttatacaaaaatcaactcaagatggattaaggatttaaacctaagacctgaaactaaaaattctaaaagataacattggaaaaattcttctagacatgagctcaggcaaggatttcatgaccaagaacccaaaaagaaatgcaataaaaacaaagataaatagcaagcacccaaaagcaaatgcaataaaaacaaagataaaaagcaaatgcaataaaaacaaagataattaaactaaagagcttttccacagcaaaaggaacagtcagcagagtaaacagatgacccagagagtgagagaaaaccttcacaatctatacttctgacaaagaactactatccagaatctacaactaactcaaacaaattagtaagaaaaaaacaaacaaccctatcaaaaagtgggctaaggacatgaatagacaattctcaaaagaagatatacaaatggctaacaaacatatgaaaaaatgctcaacatcactaataatcagggaaatgcaaatcaaaatgacaatgcgataccaccttagtcctgtaagaatggccataatcaaaaaaaatggtagatgttggcatggatgtggtgaacagagaacgcttctaccctgctagtgggaatgtaaactagtacagccactatagaaaacagtgtgaagattccttaaagaactaaaagtagagccatcatttgatccagcaatcccactactggatatctgcccagaggaaaagaagtcattattcgaaaaagatacttgcacatgtatgtttatagcagcacaattcacaattacaaaatcgtggaaccaacccaaatgcccatcaatcaatgagtggataaagaaaccgtggtgtatatatatatatatgcactatggaatactacatagccataaaaaggaatgaattaacacatttgcagtgacctggatgagattggagactattattctaagtgacgtaactcaggaatgaaaaaccaaacatcatatgttctcactgatatgtgggaagctaagctatgaggacgcaaagacataagaatgacacaatggactttggggacttggagggaagaatgagagggggcgaggggtaaaagactacaaatatgatgcactgtatactgcttgggtgttggctgcaccataatctcacaaatcaccactaaagaacttactcatataatcaaacactacctgtaccccaataacttatggaaaaataaaataaaataaaaccttttgttctttcctttatctaaaactttggacgtaaaatattatatcccaccatattaccatggtagagcttagtaaattttgacttgtgtgaaacagaactttgtctagtcctgagttgaccaattgtctctttcatgatcatgctactctagtggtttgaactatgtaaactttctagtcatctgtatatacaatgtgtcacataattatgtattattggactacatgggtctccagggaaccctcagtttctactttgacaggggtgagaatcaggaagacctcgaatccctggatgtatgttgtatgaaagggaactgtcttcaacacttctaaccaatgctaacatgataacatcacatggtttcagtccaggctatgtaaaaacacagaaaagatgtgataactaatattacatctagttctttgacctgtattttttgagattttgctatatgaaaagcagtgtaataaaaacggggcaatgaaataaatttaaatccttgtcttcactcacaagcagttactacctagccgagacaaggaaagaaaaccaatccagatagctttttgcccaaatgatccatgtaatcgaaatacctaaagacctatctatcatgtataagaaatttcactggagtatcattagcaataacaaagtctggaaacaatttaaccatctaacatcgtgagataaattaaataaactggtatatccattgaactatccagtcatctaatagaatgaggtaaatctctgtgtggtgatatggaaagtattccaagaatgttttttaagaaaaagaggccaggtgtatgtcttttggcctcttattcttaaaaaaacatgtaaaatgtaaaatgttaaaaatgtaaaatgatttttaccttcttaggatactttaaaagctcaaaatcactaatcactagagaaatgcaaattaaaaccacgataagataccatctcacataagttagaatggctattactgaaaagtaaaaaaaaaaaaagaagaagaaactgatgcaggtgaggatgtggagaaaagggaatgcttatacactgccggtgggaatgtaaattagttcagccattgtggaaagcagtttggctattgctcaaagaacttaaaaaaaaaattactatttgatccagcaatctcattatattggatatatacccaaaggaatataaattgttctaccataaagacacatggacacgtatgtttatcacagcactattcacaaaagcaaagacatggaactaacctaaacacccatccacagtgactggataaagaaaacgtggtacatatacaccatggaatactatgaaaccataaaaaggaatgagataatattctttgcagcagcatggatggaactggagaccattatcctaagcaaactcacacaggaatagaaaaccatctacagcatgttctcactattaagtgggaactaaacatcgagtacatatggacacaaagacaagaacaacaaacactgaggcctactgaaggttgagaggagggtaaagattaaaaaaaaaaaaaaaaaaaaccctacctgtcaggcactgttgattacctgggtgacaaaataatctgtacaccaaaatccccacagcacataatttacctatataacaaatttgcacatgtacccctgaacctaaaatagtgaaaaaaaagaaaaagaaatcatggacagaatagtgtgtataatatgcccccaactgtaataaaaagggtatatattcatggtacatatgtatgcttatatatatccacagaaaatttctggtagggtacgtaattaactcttaaaagttatcacctcatgtaggtaacaaggcttagacatgcccacctccagagtatgatcacagccaatgttgaagaaaatatgtttcacgtaggaaaaatggtttaatcctgttttccaaatgccaaagtttgggattaaagttcatctttctttatgcccttttcaggtattgtggtcaataagcccaaagatggaatgtcctggccagtgattgtagcagctttactcttttgctgcatgatattgtttggtcttggagtgagaaaatggtgtcagtaccaaaaagaaatgtgagtataatactaacatatgtaggaacagattaatttttcattataaaatattcatcagtacaatatattattactctatgaagttcctcccatattttaatggggaaataatgctcacagaagctcagagagattatatagctttcccagcattacatagttgggattaaatacacaactcctgactcagtatccctctctgcattggcctagtcaggctgtaacattcgtcagatagagcaagtccgtggacatgaaatgagaactgagcctcacctctcctcaaaactaaaactgatttttcttttaatcttcattattttttcattttcatgcatctttgaactgcctaggctccactggtcatagatgctcaagtgtgaaattgagtgagaaaggtaattttaagagatttccagctgctttttttaccagagtgggcttttactgcccttttctttttttcccaagcagaaaagaaagtaagcattgggttaccccatttttgtcttattgaaatattttccaaaagccttctccaatcggcagtctgaaatggtacataaggttaagcctcatttttctgacttgctattttgagtcagtctgggttgggccataactggaagggaccccagtacccagaactgatcttccacttgtcttactactactctaagataacattaaccattgtgccatatgctttcctaccttttgcagagtatccttgaagactctgtaaccacatacagggagtggtgaacaaaacactaaaccagtagttagaaattctggattattttccaaggactacaatttggccaccacatgaccttgagaaactcataattccccaaaaaacaaaagtaaaacaaaagtgcatgtttcgtagaattacctattaatacatatgaagtctccattaaagcatctaaaaattgggtaatagggattagagagctttatattaaatgaacaaatgaaatctgaaaatctgaactgattttttaaattgttctgtattcaaatgtttgttttatatggagatgagaatcaatctctctatcctccttcccccactacccactctttatctctcctaagatgctatggattgccagggcatagaggtgtttgagtgatgaacataaagatgttcacagatatatttctgttgcctgatatcaagatagctagagcatttgtatagctaaattccatactaacttggctctttaatgcatttcggaaaaagagattacttgtactaacataaaatagttctttgtacaaagatgactttaagaatgttcactgattcaaacaaaagggatttaggcattatctagccagtactcggggattgagaagagctttacttcccatctctaccctatccccgcagtacatagtgagtgtttgggcaaaggctggggctagggttagcaaagaggctgtatgaaaagcttcagtcttaaatcctaggattttaagatttagtctctggaggaatattttaatccacataaaagaaacatttcttctattaggaggcagttgtcatggagagtatcagttctggtgaaaagacttgaattgttggtctggttctcttgagcaagttgtttaaaacctctgagcctcagttttatctgtagaatggtgatgcatttcctgcacacaaagtaaataatgttatgatacatttcctgcacacaaagtaaataatgttatgataaaaatgctcagttttatctgtagatggtgaggcaatttctacatacaaagtaaataatgttatgataaaaattctttgcaaactacaaaataccgtatagatcatgaggttcaaatgtgactaacaggcacagggttatgccagcaaaaatgctgaaagaactgggagagtatgtctctttctcatcaatctgtgttctcctttaaagaaacaacacatgtctgtgtgtgtgtgtgcataagactccctcaattcttagcattgaaagaccaatattttgttcctagaatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgtacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatacaaagcattgtggttttattttactgttttactataatatatgaatacaagcagaaagtgggggtagggagtggcagagttaggagtagagagtggcagagttggaggtatttggattgtttcactaaagggagagacagttttacagtataacataaattcatgtaatttatcaatctatcagatgacaggtgtctctctgtgtttttatattagctcttctttgaagtacactcttttagtatcgtaattaagttctggtcagcatttgcacattcattaccacttgaatagagtgagcggttgcttatcaatggagggatcttcagtgagtagttcagaggaacttttcacaaacctgcaaattagaggggctccagttgccttttagttagtactgtgagcttgaccacccttatttgactaaaatgacagtttcatttgagccttaaattgtgtgcgagtaaattcatagagtctgactcaaccagcaactcctgtctctgttagtgaatttagctctgtctcataggagaaatagcaatactagatcctaatccctaaagtttcattttcactgagaaaaagccatatgtacgcatgtttgtcactcatttccaaagcactatgtgttagttaacattgttattcatatgttcgtttccttacccacctgcaccaggagaactcctcagcttgataacatgatttgttttgcaatggaatatcatgggcacgactaacccaaggcttgaaaagtacttctatgattggattcactctcttcttttctaccatcaccatgagaagatcgttttcagactagcctactgtgccaagaagaaaaagaaaggctcatggagcagtaccacccaaggctggtccagtccagatcagcaaaactcacagcctacctcaacaggcacataagttagatattattgcatgccactgaaattgtgtggttattacacaacattgtagcaatagttaacctacacatatagatccagaggtaggcatattttagctcatacgtaagtgcctaatgcgtgctttatttttttaaaaaaatagtattttctattttctttggttcagcatgagttttgttttaacaagaagatatggttgacttccccaaaataactttgcatttatagatctttaaaaatcatagaacatttgaccaggatgggttttagaggtcgttttacaaaatgagttaagggttctgtgaaattgacttgtccaaggtcacacaattagaaatggtaaaaccaacgtgatgacccagctctctgatttctagcctagagtgtaatcaatatttaattgctttggtatctccttttactatagacaagagctgctgctttgtgtgcttttaggtcaatattttttttttacacttgatcttagccaaaaggctgagaagcgataattttttttttttatgccttggtagtatatgctaaaaattgtaacagaaaacaatgaaaagtagaaataattaaccctgggggatgggaagctctagaaaatgtcaaagaaaatgaggaaatgaaagagaaaagagattaatcaagatcagaagttgaaaagaaagtttagagaaacttactaaggccagagataatgaaaaatgtctcagaggctctgaacaggggaagaggtccttaaaggtagccctcttggcacccagacttaggagggtggctttgaacctgaaggttgaatcttcagaaatatagaaactttgttctctctgagacgagggctgaaatgcatagcctaaccgactgtttgacaacagcaatcatggctgtgtcaaccagctaaaggatgggtgtccacattaactggcagaaacacatagtgagaattggggaatcaaggcagttatttcccagctcctgcaaaggtacctttttcctggatttcctcgattactaacaaaggcaccatgctccagccaggaaggcatgaccagaaagcaggatactatgaccttaagctaggtcagggccagggaacacttttggaattattgttaaagcttgaatggtgcatctgtgatgggtcttgatattttgtgggtgcaaataacacagaaatgggaacaatagaatctaaatttttctcctcagacagcatctttgtatcctccaatctctgttatccaaatctccaaactctttcctgttctgcacactcaggttcctcatatttgttcaaagactgtggcattgtgattgtggggagggacactggggggaataatagggaagagcaacaaacccaatatcacaacataaagaagagagcatggctggggccatatccagctaccctgggtgaatgccacaaacttatgcacatttgccctgagttttgtcagactataccccatttactgtccaaagaagatatatcaccaaataaaattggctacagcattatgccattcaactatcaccagaaagtacttaaaagtgccaagaaggtaggctggaggggatagaacaacagttacatgaatcctgcagagaagtttgatagtggacctcatatcctgagagccatgtataagagttaacctctctattctgcattttctctcttcaaagcttaaatatctgttaaggctgaatgggaagatgatcagggatctgagaattccatctatggtagaatcatttttgcatcactggtttgagataagcctaattccactcttacagataattgggttgcattggatttttcttatacataaagccattgcactgattcaaagggacatgctttggtgactaacgaatctgaaatctaacacagtaataaataagaattgattttaattttgtggctagttactagaaaagtctgacaagcacttttcctgaatacctcttttcgatggccagtttagggtttgtagattccacactcatgaaattgatattaaaaaaatctaagaactacttattgccttcagtgaatgtaaaatttaatggaagagagagacatttaaacaaatatatacagtacagtgttacagatataaaaattaagttatgcgcaaagaagagaaaataataaagaaaaaggtatgatttcagggacaacatatgagaaatacttttaaaggcttcagaaaggaggctgtcaatagaggcaaggccactgcagtagagaccctgatatctgagacatagtgatgggacttgaaaacattacctaagggttataccaagaatgtaagaagcatctgatgatagaaaattgcttaatataatttaccatataaatagaactaaggagaaaaaggataggaataatctccatagctgtttaaaaaatctttggcaaaattcaacacccattcctactaaaaactcttgagaaaaagggatattttcttaactacatatatacataatacatgcatgcaaatctatctacagctgtatttgtagatacatatatatgtacagttatagtatataaatactatatatagttttatatatatgtatgcatatatacatatactattctctatggtatacatctatataactgcaattgtatgaatatatatgcaatgaaagaaaagatggataaatttagctacttaagaataaaaatattcatgagagagaaagcaaagtcaaaggacaaataataaagtaagtgaaaatatttacaacatatatcacagatgatatatcaatatacatacctttatcaatatacttagttgataaagaacttacaaatattgaggataaaaaactgaaaaatcctatgaaaaatgggctaaagccatgaacaaataattcacacacaaaaattaaaatgactcttaatcatttgaaaaacatgaaatgtattcataataaaagaaatcaaaatttaaaaatgtactgagacatcagttcttctccatttagttgtcatgaatttcaagtttgacaatattgtccgttatcaaggctttggggaaaacatgcacactcatatactgctgaagggagtgcaaaatggtgccaccaatattgagaagaatatgatgatatctaacaaaactatatattaatttattcattgacattgtaattcatcttcaggaattcaccatgaaactcagcctccaacaatatcagaatatatatgcacaagattattttggtatcattatgtgtattcacaaagtatttgaaattatctaaatgtccaatataggagattggttgaataaaatgtagtaaatacacaaaatagagttaatgtgcagttgtaaaaacaaaaaagaagaaaatctctatcaactgatattgagtgatttccagagatattattaagggaaaaaggtgaagtacaaagagcatgtaatatgctacctttgtgtaagaaagaaggaaaaattaaaaaaatgaaatatgtatatgcctatttttacaaaaaggaacaggagagataaatcaagaaatgctggagttgaggggtaaagaaggaagagtgtgacggatatatggagaagtgtcctttcctgcatatacctttctgtataattttgtctgaaaaaaagaatattagtattctatgtattaaaataataaaattaaataaataagaacaggaaaaaaaactaaaactgaaagaaaactatttgtattttaaataaataccataagcacactgaaagagaaaaaagaaagaaaaaactaatccaggccaggtggattagtttttaggaaaaactaatccaatccaggctcacacctgtaatcccagcattttgggaggccaaggtgggcagatcacgaagtcaggagtttgagaccagcctggccaacatggtgaaaccccatctctactaaaaatacaaaaattagccaggcatggtggcatgtgcctgtagtcccagctactcaggaggctgaggcaggagaatcacttgaacccaggaggtggaggttgtggtgagctatcacaccgctgcactccagactgggcaacagagtaagactccatttcaaaaaaaaaaaaacctaattcaagtagctaggaacacaaaatttgactatatatttgactatataccccagtctcgtgtagggtggggtgggggtggtgggaacaaggtgagaattgtaagcaaatctggaaggcttggtagtaagatttttttattgtaatgatataagcaaagcaattttgaaacattgttctgtattataagattatgtaaatgtgttgtcattgggtgcccaggttctcattgagggaaaaggaacatataaatatggaataaggaaagactggaaagaaccctgtgtagatgcagggatggagtcaaattggcagtatcaatgcaaactcatgatttccacaatatgtgtgtgtatatgtgtgtgtgtgtgcatgtgtatgcgcatgaaggttagtgtccttcccaagcatcacatctggagacccatgatgtccacctgtccttcactggtaatcttaatcttaatcacgtctgtgtgtaaatgtgcttgagcatgcatatgtgttttgcattgcaaatatgtatatgtgcctatatttcccagatgtgccttttgaaaggactaagaaagaaagatatcccggtagcaaagagcatacctagcatccgcatcttggtcttcagtataatttcctgctgaaaggaactgaactcagagaaatgtctaaggacaaagtaaacataagtgaacttgaaatactttgttaggtcagaaaataagaacatagtccaaaaactgctagggtatgtcagaaggatataggagtcagtttgaaaggactcccactgtatacatctaggaaaatttgactatcgatatagttaagtatattaatgagttagaaaccattgagaaaagcaggaattcatgagtccttaccagtagtaagtgatagctatatagataggtagataggtagtcagagagagacagagagagaaaggagggctctcacctatagcaaaacttcaagagcagattaagaaatacgaagggagtgctgaaattcagaagttatcattttgtaatcagcataataaagattgcatcaggctagaatcatcaatggatactaagttgaggaaattttgatgaagatcaggatatatgcatggtctctaagtgcctccctgtaaaatcttattggttacacaggagaaacagaaacagtaactatgcagtggagaaattagacaagaacttgaccaagtgatcaaaattaatatcatcagtgagagagacagggatcttgtgctcctccaaatgtaatactctgggaaggatacaatatcacctatggagtattagggcagagaataaccaaactaaatctaatcacaaagtagcatcaaataaatacaaaataagatatattctattgtgtctgtgttcatcagggatattggcctgaagttctcttttttcattgtgtctctgccagattttggtatcagtctgatgctggcttcagagaatgagttagggaaaagcccctcctcctcaattttctggaatagtttcagtaggatcgtgtcagttctttgtacatctggtagaatttggctgtgaatccattgggtccagggcttcttttgctttgtaggttctttgttactaattcaatttcagaagttgatattagtctattcaagatttcaattgcttcctgatttaatcttgggagattgtgtgtttccagaaatttatccatttcctctagattttctaacttctgtgcatatagttgatcatagtccctgaggatcttttgtatttacgtgggatcagttgtaatattgtttctgattgttcttatttgaatcttctctttccttttctttgttaatcttgctaccagtctatcaatctcttattttatttttttgaagaacctactttttgtttcatggatcttttgcatctcaacttcattaagctcttctctaattttaattatttttttacttctgttagctttggggttggttttctattcttttaggtgcagaattagactgctaatttttagatgtttctaacttcttgatgaaagcatttaggactttaaactttcctcttaacactgctttggctgcatcccagagattttggtaacttgtaaacctattttcattagttgcaaggaatttttttattttacccagtagttattcaggaggaagttctttaatttccaaaaatattagcaaaccaaatctagcagcacatcaaaaagttaacataccataatcaagtaggctttatttctgggatgcaaggctggtttaacatattcataccaataaataggattcaccacataaacagaattaaaagcaagagacatatgatcatctcaatagatacagaaaaagcttaagataaaatccaacattctttcatgaaaaaattcctcaacagattaggcatcaaaggaacatacatcaaaataataggagttatacatgcccaacccacagccaacatcatactgaataggcaaaagctcaagccattccccttgagaactgaaacaagacaagtatgtccattctcaccactcctgttatacatagtgctggaagtcctagccagagcaatcaggcaagagaaagaaacaaaagccatcccaatagtgaaagaagtcaaactatctctcttcacttatggcatgactctgtatagaaaatcctaaagactctgccagaaggctcctacaactcacagactagtataatttcaggtcacagaatcagtgtataaatcagtagcatttctatgcaccagaaacatccaggctgcgagtgaaatcaagaacacaaacccacttacaatagctatgaagaaaacaaaatacctaggaatactgctaaccaaggaagtgaacaatctctacaagaaaaactacaaaacactgttgaaagaaatcagagatgacacaaataaatggaaaaacatgccatgctcatagattggaataatcaatattttttaaatggccatactagccagagaaatttgcatattcaatgctatttctatcaaactaccaaagttattcttcacagaattagaaaaaaaaactattctaacatctatatggaagcaaaaacaaggctgaatagccaaagcaatccaaaacaaaaagaacaaagctggaggcatcacactacccaacttcaaattatactataaagctacagtaaccaaagcagcttggttctggtacaaaaacagacacataaacccgtgcaacagaatagaaaattcataaataaggccatacatgtacaactatctgatcttcaacaaggctgatacaaacaagcaatggggaaagaactcctaattcaataaatggtgctgggataactggctagccatatgcagaagaccaaagatggactcctatctttcaccatataaaaaaattaactcaaaatggatcaaatatttaaatgtaccttaaactataaaatcctagaagaaaatctaggaaatactattgatgacattggcctttctactagtccattctcacacctatagagacatacctgaaactgggtaatttatggagaaaagagatttaattgactcagagttccacaggctgtatggaggaatggctggggaagcctcaggaaacttaacaatcatggcagaagggtgaaggggaaccaagcatgtcttcacatggcggcaggagtgacagagtgaaggggaaagtgctacacacttttaaaaaacaacaagatctcatgagaactcactcactgtcctgggaacaggaagggggacacccacttccatgatccagtcacctcccaccaagcccctctcccaacactggaaattacaattcaacatgagatttagatggggacacagatccaaaccatatcattccactcgggtccttcccaaatatcatgtccttctcacatttcaaaatacaatcatgccttcctagcagtccccaaaagtcttaactcattccaacattaagtaaaaagtccaagtccaaagtctcatctgagacaaggcgagtcccttctgcctatgagcctgtaaaataaaaaacaagttagttacttccaagatacaatgagggtacagatgttgggtaaatgctcccattctgaaagggagaaattggccaaaacaaaggggctacaggccccatgcaagtctgaacaccagcagggccatcattaaatcttaaagctccaaaataatctcctttatgtctcacatccaggtcacactgatgcaaagggtgggctcccaaggccttggaaagctccgcccctgtgattctgctgagtacagtcctcttggctgctttcacaggccatcattgagtgcctgcagtttttctaggtgcatggtgaggttgtcagtggatctaccattctggggcctggagaacagtagccctcttctcacagctccactaggcagtgccccagtggggactatgtatgggggttccaagctcacatttcccctttgccttaccctagtagaggttcttcctgagggctctgcccctgcagcagacttctacctggacattcaggcattttcgtacattctttgaaatctagggagaggttctcaaaccttaactcttaccttctacgcacctgcaggtccaaaaccacatggaagcttccaaggcttgggcttgcaccctctgaagcaacagcctgagctgtaactgagcccctttcaggcacagttggagctggagtggctgggatgcagggcaccatgtaccaaggctgcacagagcagtggagccctgggcctagcccaggaaaccatttttccctcttagtcctccaggcctgtgatgaaaggtgctgctgtgaaggtctctgaaatgccttggaggcattttccccattgtcttggctattaacattcagctct

SEQ ID NO: 11 - DNA, 4513 bp, Homo sapiens
acacaaatttcagagaacaatttcaacattgttctgtcgaacgttatactcagtcctgaaccacattactttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgtacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatac

SEQ ID NO: 12 - protein, 567 aa, Homo sapiens
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEML

SEQ ID NO: 13 - DNA, 37180 bp, Mus musculus
  misc_feature (1)...(37180): n = A,T,C or G
gttgctctctacactgctgcctgatctgctggcgcccccgggcagaagcggcaagagcagtcagctatttggccaaccttcaaaacggagctcaaacaatccttttagttttataagctcattatctgagatctttacggtcatagcgtagactaacacaagtgtatggagaactttaacacaattcttattccgaatccctcaccctttagtgtgtgttcatcgttttacaattgagagagaggagaaacctgggtgacaaggaagcaacagcacaggatcctggctttcacacatgaactcacaccccgctgttgttctctgttgcacaacttgacagccagcagcttgcagacacggttgaactgtgggagaagtgggtaagggcactgggtctaggtggcatggggtacccaggctatcatttgccttatgccagggcccatatgtgagcaattcattctccttgctatttccttgtgattggctaattaaaattttattctgtaatctagatggaataagaactaaccaaaacaagcaaagaaacctgatacttattcactgtgcaattctgccaatagtgactcaaagttaatgcacccgacagatatcccacaatgcattgtgcttccatgtgctaccgttcagcagaaattcatacacagtctaatgcctttccttaagagcagcttggtaactttgggcaggggtgagctgactagtccagaacagagggaaggggacaagtgtacgcaatgacacttaagtcaggttattactaatttctgtgcttttctttagaacataaatggaagctgttagcatgcccttgaggtagatacacaactttaagcaaaataattttcatggtagtacatctttaaatagtggaaagagtatgcatcctgattttaacttgaaggataaaggatggagcattcagcttgaggagtgaagggggcacacagagagccgtgcattgaagttcaaaatgtctccttgtccatttgtactctctcctggctacacaatgtcctggaggattccccgtgataaagtgccaaccacaactttaatgtacttgggagggatgagtaagaaagcagactggaggtgcgacttcaccttgttttcaaatactaagccttacctttttcttcctattcaacatatttgttactttaaaaaaaatctattaatgtttgcatctttcaagtaaagttcagcacttccattggtccacattctgggagaagaggtcgccttaccttcagtggtgacgccatccatgccagttcttgatgccactcttgtaataagaatacaacatgcttggatataccactggcgatcttcaatagaagttgttttaaaaaattgggatttttctgccactgtcacacattctttcacatcttgtttattagcatgtgccagtaatcccgtttccattatgtccttgtgggctcaaattttgtagagctcatctctattacagaaatccctttctgtaccatcagcaacgggtacaaactctgtgttagtatatggagtattctcggaagaaagaagagattcttggccaccaaaccccccccccccatgtcaatgcctcgtctgcattacttcctgttatagagaaaacgtgtccaaacacagtcacataaacctagcaacgaggccgtgttccatgcatacccactgccttagtcagggtttctattcctgcacaaacatcaggaccaagaagcaagttggggaggaaagggtttatttagcttacacttccatactgttcttcaccactaaaggaagtcaggactgaaactcaagcaggtcaggaagcaggagctgatgcagaggccatggagtgatgttccttactggcttgtttcccctggcttgctcagcctgctctcttatagaaacaagactaccagcccagggatggcaccacccacaaggggccttttcccccttgatcactaattgagaaaatgccttacagttggatctcatggaggcatttcctcaactgaagctcctttctctgtgataactccagctgtgtcgagttgacacaaaactagccagtacaatcgaccccttgtcaacttgacacacaaacacatcactagtaagcctcaacccttacagtcttattcatccccaaggtctaaataactttaaaagtcccacagtctttacatattcttaaaatttcaatctctttaaaatatccatctcttttaaaatccaaagtctttttacaattaaaagtctcttaactgcgggctccactaaaatagtttcttccttcaagagggaaaatatcagggcacagtcacaatcaaaagctaaaatctccaaccatccaatgtctgggatccaactcacaatcttctgggctcctccaagggcttgggtcacttctccagccatgccctttgtagcacacgcatcgccctctaggctctagatgcctgtactccactgctgctgctcttggtggtcatctcatggtactggcatctccaaaacactgcatgaccccttcagtcctgggccatcaattgcaactgaagctgcaccttcaccaatggccttccatggcctctcacagtgccaagcctcagctgctctgcgtgaccccttcatgccttcaaaaccagtaccacttgggtgacccttacacattaccaagtcccgctgcaggaggagtacaaccttggctatctctggaacacagcctctttgtgctttaagaaaaaacttcccagaagatgtcacctcaacaatgttggtctcttcttaatcactgctaatttcttagctccagctaaccagcatcaatagtcccagtaatgccaagtttttgctttagtagttctggtatcttgttaatcacagctgattcttcagccccagctaagcagaaccacagaatcttcacaatcaaaacagcaatggccctgaaaagagtctttaattttccctctgaaatttcacaagccaggcccccatctcctgcactgttctcaacattatcttccaagctcctacacaacatctgacagagctcttaacaccgaatggatcttctagcccaaagttccaaagtccttccacagtccttcccaaaacatggtcaggttgtcacaggaataccccactcccagtaccaatttgtcttagtcagggtttctattcctgcacaaacatcataaccaagaaacaagttggggaggaaagggattattcgacttacacttccatactgctgttcatcaccaaggaagtcaggactggaactcaagcaggtcagaaagcaggagccgatgcagaagccatggagggatgttctttactggcttgcctcccctggcttgctcagcctgatctcttatagaaccaagactaccagcccagagatggtcccacccacaaggggccctttcccccttgatcactaattgagaaaatgccttacagttggatctcatggaggcatttcctcaactgaagctcctttctctgtgataactccagctgtgtcaagttgacacaaaaccagccagtgcacccaccctaacaattctgtctatgctcctggtgactgaacagtctctatagggtagaaaacaggagtcctattaggccctggatcccttctctggtcttgtctaaaggggggtggagtgtcctggagcctccttttatgcagcagctgcttctagatgaccagagagaggcagaagcctggaaagtccttcatctggtgcctgggtctcaatgaacctcagcctcacgagtcacagacaactctatcttttccttgctgcttcaaataggcatttccttggagtatctaccatgcaacttattttctgtgttgcattttccttcagttatgaagcattgtctactattaccagagcaactaaaagtatcagatatccattgctgtcaataaggggtggaaacatgcaagccagaaactagtggtgagttaggaaggcttatgagtcagaccaatgaagctggcaccgagtagactccgggggttggccagtagccactgtgttcagtttccagtaaagcagtatgagtgggcttagaggtgacactggagtctactgttgtggtgtcggggtgtacgtatcggaacggtgtcggggcagattttggtggtgttccaaatccccccaccaagatttcagcaaccttattcataaacttttttctgtttctatttgtttgagttgttcttggctacccaacaccaaacctccccttggggttttgctgaagctattatacacagagttctccagtcactgtagatcactgaggaagtctttgcttcactaccttgcttcctggctctagtaaatgaattacctggaaattcacccctaagatagcacccttagttgcagaatgaatgccgtcacctatacaaggaacatgcacagagaagcaagtaagaaatatttcatactttgaaaggggaacatgacacctccacatggtgaccttctgcagatgacactggcttgcgcaaggaggagactgaagggtccagagagtatcatgtctactcagtttatacagcgtgcacagcgagccaggctctgtgacagcagatgtgacaaagtcatacttccatgccacctcttcttatgacagagtttccagggagaggaagtatataagaaaataggctgtgccaacagagctctgtactggcttcctgtaagctgacttataatagcaagttcttttacctttgaacaggtacaggccaaagcctgaatacggatggcttgaaaccgccctatctatgagaatatcctctgaccccacctatgcttctaacaggagttcaatgattctcagttctgtgctaattgatgttgttccataattcaattaaatattatagaagccagggaaactgggggttgttcctcaaaacaggatgcagaatgcttaataaagacttgataaaggaatgacataaaaggttacagaacctacagcatgcagcaaacagcgtaactgtttgtaatcccagagttagggaggctgaggtagggtgactgtaagtctgagcctagcctgaggtacgtagtgagagcttgcatcaagaacaatgtgtggatgtgtgtgcctttattcttatcattcctttctggcaaggtccctccctaaacccagccctcattttctcagctagtctgggagattgagccccagcaaatctacagttacaggcatgcacggggatgcctgacttgatatagaggggctggcatttaaacactcgtcttcatgatttccctggaagcatcttgagtcatcttttcagcccctatctcttctttttagaccatgatcttaaactgagcactccaagattgtacggcttgaacatgctcaggaacacgtgcaccttccaagtggctttctgtgtgactatgtatgtcctccctacataaaagtcctgtgttttctatgttgaaaaaggacattgctttggaaacaaattccataccttttttgtggcaggcaatggaccattctctgctcttggccatactttttttttgtctttgtgtgtatcaagatgcaaacccaatacatttggttacagaagccagcacacttgtggcatgtggaggagcatcctggcaggttttatttaacatgagtagggtaagacaggcacagaccttttgaaaggcttccagaaactgcagcctacattgagaattacttacaaagtgtgcatgtgagtctctgtattgttttatattatctgtcagttctcctaaagaggtattggtactcactggtgtcctctaggagtctaattagagagcccaaccccctaaaatgtagccatcacacttacgattatttatgccacatttgcacttggaggtttttcttatttgcataatgaagactagcaattggatttacaattggatttgctaaaattaataatcatcaataacagatgttataaatggtgcctgttggaggacccagctataccactcatgggcatatacccaaaagatgctcctacgtataacaaggacacatgctccactatgttcatagcaaccttatttataatagtcagaagctggaaagaatccagatgcccctcaacagaggaatggatacagaaaatgtacatttacacaatgcagtactattcagctattaaaaacaatgaatgcatgaaatttgcaggcaaatggatggaacctaaaattttcatcctgaatgaggtaacccagtcacaaaagaacacacatggtacgcactcattggtaagtggatattagcccaaaagcttggaatacccaagatacaattcacagaccacatgaagctcaagaaagaagactaaagtgtggatgcttcagttcttctcagaagggggaacaaaacactcacaggaggagatacagagacaaagtgtggagcagagattgaaggaaaggccatccagagactgccccacctgcgaatccatcccatatacaatcaccaaacccggacactattgcggatgccaagaagtgcttgctgacaggagcctgatatagctgtctcctgacaggctctttcagagcctggtaaatacagagtcgaatgctcacagccaaccattggacagagcatgaggcccccagtggaggagttaaaggactgaaggagcttaagggggtgcaacccataggaagaacaacaatatcaaccaaccagactccctgagagcacccaggaactaaaccaccaaccaaagagtacacatagagggacccatggctccagctgcatatgtagcagaggatggccttgttggacatcaatggtaggacaggcccttggtcctgggaaggctccatgccccagtgtaggggaatgccagggcagggagacaggagagggtgcgtgggtgggtgggtgagcaccctcatagaagatggggagggaggataggatagggggcttctggggggggaccaggaaatgaggtaatgtttaaaatataaataaataaaatatccaataaaaaagaaaattaaattaaaaaatggtgtctgttgatatctaagaatatttaccaaacaaaattagaagcgtccttcttgcttctatgaacagcatacaactaccagtctgggaatggaaaactttctctaagactccaggtactaagtattttaggcattgtgggacccaaagcaaagcaagccatgactgcactcctaagacttattgtagagtagcagaggctggcacatgcacagctctgacttgcagattttcatagtgcgagcatgccagtcaatatttggttagagaatctataaaaagattaaagcagagactcataaatggtcgaagtgccaagtgttagtgactctaggtacctagctgtgatatcaacctcccatcttcctgaaagtttagagaacttccaggaagagagagcagaatgactgatggggccttaagataggggtgagaactgtgggaggctgtcatttggatacaacatggctgtatcacatatcagttcacagcagctatggttacctgcagaagatcagccagtcaacatcccagcacagagggggtggggctctcaaagtctcatccccacataaggaaagctactggcagttgatgcctgcagaggaagggagaattattctccttgggggttgtggttgctgacaggttgcccatgatccagtagatggctacacactcatgtgttttgaactaattcatacaaaacaaaaaagagggcatgcatctggaaatgacgtggagttgggacactagagggggctggagagagtctgtggtagatgcacacagtcagtacacatagtctgtcctagttagcactctttgctgttgtaaaacattgaccaaaactcacttgagggggggaaaagtatttatcaggcttatgggttaaagttcatctttaaggagagcaaaggcaggaactgaagtagagaccatggaaacatattgcttactggcttgcttctctagcttgttcagtttcctctgttatacagctcagacttgtctacccaggaatggtactgcccacagtggtctaggtccttccatgtcaactaacaatcaagaaagatactcccagaggatggtccaatattaccaattccttaattgatgttctgtcttttcaggtatgttgagttgacaactgaaattgactatgtcattgtgtaagtgtcaaggaataaaaaaatactattataaaagaaagagaaacaaaatgtggctattaacacacaggcaaaggaatatgactatttggtttatgttgtttttacaggtcacacagattgctcttgattccctttcaaaaaaaaaaaaaataaaagcaaaatggaaacgccattttaaactcccacgtcagtaaaacgaggcaatggttggggctggggagacggtaaagtgttctctgtgtgagcacgaggaccttagcttggattaccagcactcacaggtgggcctggtggtctgtggctgcgatcccaatcagtgcccggaggtggagacaggaagatccctgtgtgagcttcagcttcagtgagagactgtctcaggaagatggtaacttagttacagcaccacagtagagtactacttctaaagaccttttagcaggtgacagcctcccgtgctgtgagggagccttggctttgtagttaagcaggctccaaaggaatccttctgggaggtgggaagcagctgcagacctgagagaatttgagttgaaatggattccgttttgttccccaccatgagataccagccagaaagatgtcctatggcccttgggaactggcaccattagaaatagcaacactgttgctagaacctgcagaggcctcagagtcacaaacattgggccagaagctggaggtggttgctgcaggccatctgatcacactgtgaacctgagattgtgaactgtttctaactgtgatacgtcccagcctttgaccctagagctttctgtctgtctgctgtaaactcgtggtggtgtggctcagccctagcaaagcccttttaacaaagtcaaccctaggtcaagaggcagagccagtaaccatctgacagggagtgaacatagtgaacagaaagggggtcttcgagtgtttaagacagcgtggagaagaaaggattctttccttctgggatggagtaggaaggtcagctgggtgctttctctgcctctcagagctaggaagttatcatctcagcatctggctcctgagttttcattggtaaaattgaacagctgggatttctgttttttaaaacagttttaaaaaacaaacaaacaaacaaacaaacaaactttgtgtgtgtgtgtttcacatcatgcaccccggtcccattcatctccctgtcccctcataatcaccgtctgcccttgaaactccccccagataaaaacacacaaaacaaactaaataaaccaaaacagagcatagaaaacatcccaccatggaagctgtggtgtcctagtgtgtcccacagtttatccctctgtccacacatcttcacttgcaaatgtctatagcaatgagtcattgttgccttcagcagtctctggctcctgtgacgccttaaattttggatcctcactgagacccctcccggaggaggagttactgccctttgtccaggagatcctgcagctccttcaggtgctccagcagttcatagatgggttagatctcagagcgctggatctaggctttccagcaccatcagggcgagctctcctagctggagggtttctgtgcactacgtcctcgtcaccttcctgacttgcttagtttcacttttggtctcaacagtaaaaagaaactgcatgggcactccgccttctaactgtgaccttctcaggcactgctgctgggctgcaagtctgcattgggaagtcagacctggacagcagtatgccttcctcaggggccctgaaggacctcagcttcagtcagcacttcaggatgatggtgatttgcatagtgctcctgcaggtgctcctgcaggctgtgtctgtggctgtgacttacatgtacttcaccaacgagatgaagcaggtgagtggccgtgtgctctcagcagcagcctctcttggctttgccgcttagcttgctcttctttgaaagcttagctgtagattaaaatatgcctttcccaagtgcagactcttaactgctaataaagagagggctttataaaactgcaagttggcagacttccaagcagttgtagtaacagaacaggctatgaaaactacaaatggatataccggcacctccaagaaagtttgctatcatttcaaaagtgtctgtgcagggtgcagttagtggtgtcacttggcacaaatgctttgtgtgaagtactctagagttccgtgtgtgtgtgtgtgtgtgtgtgtgtgtgtgtgtgtgtgtgtgtaagagagatagagagatagagagagagaggaagagagaggaagacagggagagagaaagagaagaagagggagagagggaggaaaagaggaagaaggaggtagagagggacagagaaggagagagaggaagagagagagagacagagggagagaagaagagggaggacagcacatggtgctgtggagcctagagatagatgtcagctgtttttctccctaactctccatgtagtttttctgaactctcacccaaccttgagctcattgtttgcttgttactgactgagcctagacctctagacttctgccctgcagttgcctggaccttgaggtgagggagtggcatagattaccccatgcccagcagacatctatcttgtctgcactttgaccacttgtaagtctgtaataaccactgtcctccagacaaagaagtgggtctgaaaaactctcaaacaaacaagtcacactttgaaaagctggtgggtagaagagcaagtgtctgaacaaatatcaaagtgaagctcaaagagttagcatttgtctctcccgtgatcggatagtgattagaactcctgatccaagtcatggaaccaaatgttgtgttttatacaaccacagggaaaagaatgtttggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagatggagagcaagaaggcaagagagagaggagggggaagagtcaggcacacctggctgttgccaggtaacctggggggggggtgtaagacaaaatgctaacacaaagtatcacatttctcagtccagtaaggctgagggtgggggtgcacataaaccagatgtttgaaatgtgtttggagggaggaatcagtcagggaagtgcttcctatgtacacgtgagaactcaagtttgatcctaattacccagcatgcacctgtaatcccagtgcttgcagggagaagactgaagaatccctgagacttgctggctgagggtatatgtagtcttactagtgaactccaggccctgtgagagaccctgcatatcacacacacacacacacacacacacacacacacttttattttattttttaaaagagtatgctttgtttttaaataactcagaggagttcctgtgttgacaatagtgtgaacacaatggcctggctttccttccaccttttcctctgattagacttgacttggctagtggtttataatcaggatttaactcctcctttgaaaaaagttggactttatgtcaggaggaacctagatacaaacgcagaaaatcccccgggactgggaatgccaaactgacaagagttaaaaccaactccacttcaggttgctcgtgtccaagttgggtagacatatgctctagggagccgaggagtggcagggatggtgaacaccccactcccttgtctagaacctgatggagaaatgaattatccaagtttagacagggctttggagccagggtagagccagagcccagggctgtgggtgccaggcactactcgccagccccatcccccacgtaatctgcactgtgcacattgcccagtacacagtgcaacatccgacctgctgtcttgtttggaactgcatggtaagggaaagtttccagaaaaatggctgtacaaaattcacagatagcaatggtctccgggggccctgcagtttgtatgtcctatggagcaggactttgataatcccaatcagttggaaatttttccaagtgggtgaggtagattttccttttatttgaaaataattatgaaaattatggctgatggtgatttatttattatagggcatgctggtcaagaatctccgcatacgtgtggggccagaggacgacctctgatgtcatttcttggataccacctacctttttttttttctttttcttttgttttctcttgcttcctttcttcccagttattatttgagtcagggtctctcattaacttggaactcacctggtagagtctctcaggggccaaccgcagactccatttctctccactgggactccaggactgccttgcttctctctctctctctctctctccctttctttcattttttccctttcctttctttctttttctttctttcttccttttttttttgttttttttggacagggtttttatatgtagccctggctgtccttgaactcagagatctgtctacctctgcctcatgaaggctgggattagattcgtgcattccccattcattgcctggcttagtcctaactttgtttatgtggcttgggggatggaattcaagtccacaagtttgtctggcaagcattttcctgactgtgttgtctctgtatcctaaatttgtatatttctttctttaaaattacatttatttattatttatgtgtgtttgtgggggggaacatgctgtgtcatatgggtggtatcaaaggacaacctggaagagttaatttttttcccttctaccatgtgggtcctggggattgaactcaggtcataaggttggttataaatacgttggtctttgagtcatcttgtttgccccaagtttgtatattccccgagaaatagagtataactattgctacttttcagttctacgtttatgtaagagattggagcacatctgtggttatagactgtggcagcacaccccaaggtttgttaactatacagcataaacagagtgagtctgtctctgtgcacaggtgtccgagcaactggcacaggtggcaaggtggcctcactccctctaagatttccccaatcctctgtcgactctggcagtccgattggataattaaggtttccaaaattctgctcgaaaatccagcagttacaaataaagcttagagtctcttcacacagacacatttcttgaggcagaaaggatgtggtgaagtaaggatgtggagggagagaggaggcaaaggtgtcgccagaatagcctgtctgcaaggtctgcaagcaagctgtggccagcgtggttcacacctgtgggtgctaagtgtggacgaggagtgggcgctgaagctttccctctgcatggtctttgccaagaaatcattatttgtgcaaaaaaatatctcgtaagaccaacagcagagagttgacaattgtgagctcaagacggtagaataaagtgcacctttctttttcagataatatacgttttctaaactttctgtggtgaatgtcataagaatggtttgagctgtcgaagtctgcagttctaaaagagtccaggaactgggcaagcaagcaaggcaagaactccaccgctgagctgtgcccttagatttcaaagacatgccatgtccgcataatcgtaagagaaaataatcacagccttgcatacagtctggttcccagccatgtgcacagagggccagccagggcttaggcgcatgcggggctactgttttcagtttagtatttttggtttgtttttggttttgttgttattgtttggtttggttttggttttgttttcagattattagctgggaccaggctggcctcgaactcagtaatccgcctgcctcttcctccccctcccgagtgctgggattaaaggcgtgcgccaccactcccggctgggaatttgctttttacctttatgaaaatgttttttgaattgtccatgtcgtcttaaggcttctctaagcttctagtttattttcacttctaccattgagtcccacaccctgccccccaaccctccactgcttcattaccgtttatgtagtaactcaatcacgttcgttaacttgtataccttctcagaagccgacccaacccagatacccactcccacctcctgaaaatgtttctggaaattcccagaaggtatcctggacatgagccagctgtttaatttgggctgggctgacttaattttcctcctagggcactttgtcttcctcagactccaccccagttataagagaacacttagacaccttggaaagaccacagcaacaacagcaggtccttcctgccctggaccctaaccttccaggctctcaaccctttcttgttgagataacccactgctaggaaagaaggagacaaagtttccctagtgttcattagtgttccaatgagccaccaaggtctctgtggctgctcattcggtttaaacagtgaatggttggcaattcattaagtttggtttatacttttgcttagaggtacattgctgagtgtagaactttgtgattctggacagaaccttgcatgaataatggaatgatttttttttttttaaagagatggcttggtgctggagtgtagctcagatcatagaatgcttgcctagcaagctcaaagctctgcttcaatctatagcaccacactacaccgagagagctgttggatgggctcctcgagcttgggaggacagagacccaaggatcagaaactcagggtcatccttggttatcaaggaagtgtgaagctagtgtggaccatgagaggacctgactcataatcaatcagtcactcacttagtcactcactcactcactcactcactcactcaatcaatagattgtttttctataggaagggtgagttcttaaatttaccaccaccccaaactttgcaggacactaaatttaaataatagataaaagtattatgtttaggccaggcatggagggggatgcttaaaatcccatcactcagaaggcagaggcaaagggatacctgtgattttgagcccggctccttcaaaacttactccagttaaaggcaaatcaacggatatttttaatcaacagtgatagggataggaccaagggcttcatgcataatggacatgcactctaccagtgagccatgccccaactctactcttgttttcttctgttttgttttaacaaagggtcatatggatttgtacaggctggccttgaacttgctctgtagctttgacaagccttcaacttgtgagtctcctgcttcagtcccccagctagctgagtttacaggtaccatgtcaacaagcattgggaaataacaggttgtgtatccaagctgtgaggaaacaaagccaaaggagaaagaaaaaaaatctagccaggtgtggtggcacacgcctttaatcccagcacttgggaggcagaggcaggcagatttttgagttcgaggccagcctggtctacaaagtgagttccaggacagccagggctatacagagaaaccctgtctcaaaaaaccaaaaaaaaaaaaaaaaaaaaaaatctaagtgagagggagtcttcatcctcctccttgccctccctcctgatttggtaacagcctgtggtaatgagcatgttctggctcagggcaggcatgtgtgaatgtgtgggaatgggggttataatattaaggtgtgatcattggtaagggtaaggactttggcggcaattatgagggtactataaatattggcttcctacaccttcagtggcgcttaaagtctccttagatcagttcctaggcgttgctaacaaccagcgagtcaggattgagattcctagtgataccttgggtccatgcagagtagaaacaatgccattaggtacagtgtactcacttacaggagctgtggttaggggcagaacacctacagttcaccaaatggttggttgccttttgttaaggatgtgggcatttaaatggattccactccctagttcgtacataggcaggtttccagctttggagggagagccacgctatcttagacgccatgctatctctgaaggttacttgaaagtaacctttatcatcgccacaaaggtctaatgaggaacatgtgcatatgagggaaaataagaacgacacatgtcttcgagagatggggcagaggagagcacggtggtccaggacacctggcctatttctacacccgctaccatacctagctgcttagtatcgatggacagtgggtggcatgcctacttttatttaaaccacaaactgcccatggtgctcatgattctctcaatgctcaccactttctgatcttttagcttccaggaaaagcatgtgttcaccatacagttatgtcttctctccacccagctgcaggacaattactccaaaattggactagcttgcttctcaaagacggatgaggatttctgggactccactgatggagagatcttgaacagaccctgcttgcaggttaagaggcaactgtatcagctcattgaagaggtaggtgttcacaagagcaagaacatgaggtcagaggagaaaaaatgtgcagacctttaagcctggaaatctgtatttggcaaatgaagaaaccaagtcccagggtgctccagagattcgccagcaatatggtgttctgtctgatatgagacagcagataaagccctggctgactgtacagtgtctcctgtaggttaacctatgcatttactctgggaatgctggcacaggcagggcttgtgctcaaggtcacccagtggtttctttattcatttcttatcatttagaagacaaaagaggcccaaatgatggtgattcctcttcctcccccatggctgatctctaaaattaaatacacatttaatttttgcatgcatgtaaagaagaagacatggggcaagggaacaagagatatgttgagaagctgaaggttatctcaattcattgtcgacaaatgacaatttaggcaaatggcgtctgtcgatggaagttgctttgctgggatgatctctggctgaaaactcgtgtggctaacagttcatttcgctgaatgtggttaactgattttacttttagattaagtcaagtcagtcccttctctgcctgcttccttctgctatgatggcatttacaaatatttgccttctgcctttctgaaaaggtcagatgaaggcactgatattaaaattactttgcaaactaagaggctccatagatgagatcactgtctaaggatagagtgggaaatcccagtgtgggaggacggatgctttatgtcagatgtatttaggagtctgttgtttgttccatgggaagagtattgtcctaatgatcgaggctctagtgggtaacttgagcagtattcacagtacggtccagacagcacctggaatgtggcttctatgtcaaatgaactgtgtgaacgctccctggctgggtgccattaccaacagttggtagggtgactgcacatgaggttcaggaaaaggccaggctttggacaggtgtgaaggaacatgtcttagtcagggtttctattcctgcacaaacatcatgaccaagaagtaagttggggaggaaagggtttattcagcttacacttccatactgctgttcatcaccaaaggaagtcaggactggaactcaagcaggtcaggaagcaggagctgatgcagaggccatggagggatgttacttactggcttgcttcccctggcttgctcagcctgctctcttatagaaccaagactacaagcccagagatggacccacccacaaggggcctttcccccttgatcactaattgagaaaatgccttacagctggatctcttggaggcattttcccaactgaagctcctttttctgtgataactccagcctgtgtcaagttgacacaaaacgagccagtacagaacctcagattccttccaaagcctttgccttaaggggttcagtgaatcatcagacagacagacttgaactatggagcagtctggaggctggggtgctagcaggtacaagggccaaccaagaagaagatataagggaattaagaataatagatttttttttttctgtcagtttccattacttccctctcatcctcccagacccatcatggacatccagggtggagaggaactggcaggcagaggacatggagcaggtggatgtgagcacaggagaggaatttcatactctgctcaggcacactgagcccttatttcctgtaaacatctgcccattttgaacatctgtccgttgaattctgagagcagctgcccaggaaggaatcattgttatgctttttaaacacacatttccagacagataaaggcatctcaggtcagatcagctaaggaacataagctttcttaatgagctggggaggaaagccttgactcgtggtcacctgacctgctcctagtcaccctttccctggcacttgctttcttcttccctcaatcccaacctcctttccctttccttccttcatctctctcccttcctttcctctctcccccttctttcttctttccttcctgtcctaaaataagagaaagaaagaaaaacagaaaaaaagaggtgagtgttcaagcccaccttactccctgtcccttctccagagcccgtgggggcaactccagtaaacgctggctcagctaggggaggggtcgaagcaaaggaaagacagaaagcttctactttatggtgtggggcaccgctgctgtgctcctgacatttgaagtaatatggtgatgatggcacagatcctgagagtgacaagggatgggtggagggggttcagaagtcataaggactcaaactgggttctgtttcccaaatagcaatgcccagtattttcttttgcactgattttctgcattggttactacaaaatctggggcagggggttgtaatatgtttagcaatatatggaactttgctaccatttctttgggccatgaacttagcatcaaaactagagagtaacatggtggcaccaagtcagacatttgtagagtgagcatgtctgtgggcatggttcagatctacataatagctccagatgctgggctctgtctctcacacacatagacacagacacacagatacacatgaacacacacacacacacacaggcacacacttatatatgcacattcaacacagagggaagggacatggttatcatcagcttcatggagccctggagacatggctgacctatgcagtagctgtgcccctccttcctagccactccaagtgtcaatcagcgctttcagattgtccttcgatcacggtatctcaggattcatcccatatcccccacaaactcctatgcttagattaaagaagtccttctgtattgatgtcactgtagacgtgtcctgttccacgtcagaaagaaactctagaagtatgtatattctgttgcatttttagggacattaacactcttattcaatattatttgtaggtgactttgagaacctttcaggacaccatttctacagttccaggtagtaatattttgttatttttgtttgctactgtctatgtcacagctgagtagctctgcagtctctccttgctcccatccatacatacggtgaggaccactactcactcactgtcttaaactgttccttgactctttctgtctttgtaccgagggctggaaatcttgggattaacttcatggcctcctcatggtcagaactttgttctttctttatcctttatctccccccccccctcatatgaactttccttctacttcagtttctttcctaatgtgattattttgctataaatacaccatcataagtattatttagaactcggcaggaagtaaaataaagttctccaaaaactacccatcttctctgcctctgaccacaaggcttttcttcaccacaagcccctcagtgtgtcagttcttccccagcaagctatctacctacccctgatctcatctgtgctttctactggagccacgagctcagcagccttttctttattttgtttttctcactgtgatgacccaggctttttttatcacaccattggttctccttctcttggccccactcactccgtcccagctcacagaagtctctccttggcacatttgtaagtaagctcccctgtatcttgttatttctatcacctttacttacctcgtatttttatatataattttatccatgtattattttctcacccaccacattgaaatgactgtgaatagataatttgctaagtcttaatggcgttcttcacagaatagagaagacgatcttgaattcataatgaagcatgtaaggccccacatacccaaagcaatcctgagcttaaagagcgatgctggcgtatcactgtccctgatttcaggttatactgcagaatcacaacaacaaaagcattgtggtacagatgcaaacatggacaggcagatcactgaagcaggataaaggaaatggccataacccatagagctacaaatacctgttgtggtgggttgaatatgcttggcccagggtgtggtattattagaaggtgtgaccttgttggaggaagtgtgtcactgtgggtgtgggctttaagacccttgtcctaagccagtattcttctagcagccttcagatgaagatgtagaactcctagctccttctgcaccatgcctgcctggatgctgccatgtttctgccttgatgaaaatggtctgaacctctaaacctgtaagccagccccaatgaaatgttggcgttataggagttgccttggtcatggtgtctgttcacagcagtaaaactctaagacacctgatttttgacaaagaggtcagaaatacactttggataaaagtctcttaaacaaacaatccatgcatccacacctagaagagcgaaagaaaataaacaacttagagtgcattgaagatcctaatagaaaactcgaaactaccagagaaaagaagataaacataggcaaggattttctgaaaaggactcaggtcacacagatgccaccaactaaaaatgggactttgtagttagcctacaaaatgggaagaaatctttgctaattatacacaaccatacacacacacacacacacacacacacacacacacacagagccatatatatatatacatatagctatatataagatagaggattaatatctagaatgcatgaaaaaactcagagcattcaagaactcatatgacccactcaataaatgaacagactgttatcaaaagttactggaaccacaatttccagtaacacaggaaatacatgttcaccctcactaaccattagagaaatgtaaattaaaacactgacatttcatctcaccgcagtcaaaatggtccttacagcaagcgtgggtgaaagcaggagcccgtctacactgcgggtgcaaatgctgaagagtccagccaatatggaaatgagcatggtgttccactgacaatgggacttcatgaaattaaagcactgatgcttcgtggtggccctgaaaacaccaaaaacaaatcttccacatgacccagtgtgcataaagatgactaaatcaagataccacagagacacttgcatgttgatgcttagtgtggctctaaaataggaaaacatggcaccaatttatgtgccctgtgagaggaagggaagacaaaatgtgctgtacacatagtaggatttcctcaactgtaaagaatgaagctacatcatttgtgtgaaagtggatgcaagaagagatattaagtgatccaaactcctttcagaaagacagctattgcatgctttctcttaggcatagatcccagagcttatatgaatgtatgcaattatgtccacatgtatatatgacatgaaaatagaaatgaaactacggatcacaggaactaacaggaggtgggagtaggaaggaggcagggggatgggttaatctgctcaatgtgtagtgtgtatttgtatgacagtgttcttaggaagacagaactgttgtaccatgaaaaatatatgtataataagaaaattaaaggttcatatttttgctctcaaatccaggcttttttaaaatagccttgaaatgatctcaaatgcaaactggatctttctatttaaaaccaaagggttaaagggtaggttcagactcgtcatgatgcatgtaaccatgatggtccatggtgaactgacacatagaccttgacagttgcgcgttctgactgagattaattgtaattgactctgtagctccacctcacacttagtctttaatattctcccaacatgcagccgctcttatgaactcacagctaatgtggctacttcacgagctgtgctggtgttggagtgatgcggagcttactgtggctcttgtctgagcaccacacacgtttgggaaatgttctctagcttcaagaactctgaaagctgtaagaaagaggtgccaacttactgacagaggtcattctatcagagtaacagcagaaaccctaaaggccaggaggtcagggctgatgcttttcaagccccagattaaatcaagcaactgcagatcaagaccactacatcaagggccaacagggtggttcagccggtaaaggagctgacaatatgagctgaatcatagattgtaaatgatgaaccatttcaaaaagctggcctatccaagcatgctgcagaatgaacacacacacacacacacacacacacacacacactaggtcatgtggaaaattagtgtttagtggtttcagggcctccatgctcatttccatattggctggactcttcagcatttgcacccgcagtgtagatgtgcccccactccccctgtgcttgctgttaagtgccattctgactggggtgatacgatacacacatgcacgtctgtactattagagctgtgagggaggagagatcagcagccaccagcaaggcttcaggctcccaaggggagagttacacagagcgagacacctgacatcctcctctgacctctgcacattggcacacgatgcatgcatctatctgccacatatacccacaccgcccctccattcatccaccccacccccaccatgctcttttcagaaccatgtacactctatctggtttcttagatgctcaggagaaattttttgcgttgagaagaaagcgtggcttcctaaaataacaagaacaacattaacagtgatttataactaataccagataaacagaaaatggcttctcctttctcattcgctcctccttatgagaatgtactgcctgctttggcttctggagctcccgacctcgaggttggccactgtaatttgcctagcagcccctctgcccatcagactagaccttgacataagctggcctgaggcatgacacatttctttacaccttctagtgtcttggggaggcagcctaagtcttgtgtagtttgtttccttcaagttggatctgcacttccttcctttcttctgtcctgggccttgacgttagctctctggcaacatctctcttccatcatgacagaccctctttgccttgtttatctgcacacctctgtttcttgattattttcaagcattctccttgtcactagatgggcgcctgggatagatgcggtgatcgctttaacttacagggataagcaaccgaaaagttcctaacagtatctgctcagcaaaccctcctctgacctcaggtctctagtaactaggactctgtccttcctctgcttagggggtccctcttacctctccttctcataaaatatagtaaattcctcaagaactcagttgaatcaatggttaattgatataactctgcatagcgtggtataatttcttgtcattgccaatatttgtttgttgatagaatgtaattgatcttaacaaaacgcaggcaggaatggggatttgaagctatattttaaaagacattgttgtataagttttatattatgcatgtgcacacgtgtgtgcacaggtgtgtgcctgtatgcacactttggagatcaaaagaggttgtcatgtgtcttcctttaagagtttctgtctattccctttagatatggtctctcacagaccggagttaggatgacagccagacaacccccgctctccccttgtctccattcaaatcttccccatggctttctcctggggatacagcatgtagccatgcctgagtttttaggtgggtgctgagaatctaaactcagatcctcttgttggccctggaactggagttacagaccagggtgagcagccatgtgggtggagggctcaaaccctagtctccctgaagagcagccacctctccagccccactatttgggctgttttatgaaaccataggatgagtttgggaagggtctgagctcaggatgcctggtcagacacaactgtgtgagctgggcagtgtatttgagaagtgttttgacaagcactgatgtttttctgccttgtgtcttttagaaaagcagctaagtactcctcccttgcccagaggtggaagacctcagaaagtggcagctcacattactgggatcactcggagaagcaactcagctttaattccaagtaagatcatgagggctggggtgggggctggcagcagggtgaggtgaggctgacacctagcatttgggagactctggaattgttgaaagtagtttaacttctatctgaagtatctctgtgactctaagggctcaatagggatccagtctcagacgactgttttgtgaagcaagaagacacacagggaacccgctaacactgccatagctggcctcaggaaagtgtgcactagagagcactgtgtctcactgggccacctttgttgttgttgttgctgctgctgccatcttctcctcccatcctccttccctctatccccttcctctcctcttttattgaaacagtggttcatggcaggcttcagaactccaaactcttctgtctcaagctcccaagggctggcatactaggcaccagcacactcagactttttaaatctttaaagtaatattctctctctatgtatatcccttcttccctcctcctctcccttcctctctttctttctctcctcctcccctccctccctctctcccacctcttcctccctctctttcctctccctccctccttctccctctcctccctctctttccctctccctctccccatccctccccctatgtcccttctcctcctccccttgtggcaactcttccatcttaaaatctacagcctttgaccccaccacagtctaatccacagcctttctcttcaccataaggcactaggatctcccatcacagggacacttttgaaccacagggaaccacgaacctgtgtgtgtgtgtgtgtgtgtgtgtgtgtgtgtggtagctggcaggagggacagacagtaaacatgtcaaaatgatccaggaacctcccagttttcaagtgattagcttttgtggtccatgtcagatgaaaagtgtaagaaggtggattttggaaccacattgtgtgcaagcccaatgaaaatactgactgtgcggagcagttgaggtatctcctcattcgatgtaaacgtcttcccactaactgtttcttttgtttccacgtagtctccaaggatggaaagaccttaggccagaagattgaatcctgggagtcctctcggaaagggcattcatttctcaaccacgtgctctttaggaatggagagctggtcatcgagcaggagggcctgtattacatctattcccaaacatacttccgatttcaggaagctgaagacgcttccaagatggtctcaaaggacaaggtgagaaccaaacagctggtgcagtacatctacaagtacaccagctatccggatcccatagtgctcatgaagagcgccagaaacagctgttggtccagagatgccgagtacggactgtactccatctatcagggaggattgttcgagctaaaaaaaaatgacaggatttttgtttctgtgacaaatgaacatttgatggacctggatcaagaagccagcttctttggagcctttttaattaactaaatgaccagtaaagatcaaacacagccctaaagtacccagtaatcttctaggttgaaggcatgcctggaaagcgactgaactggttaggatatggcctggctgtagaaacctcaggacagatgtgacagaaaggcagctggaactcagcagcgacaggccaacagtccagccacagacactttcggtgtttcatcgagagacttgctttctttccgcaaaatgagatcactgtagcctttcaatgatctacctggtatcagtttgcagagatctagaagacgtccagtttctaaatatttatgcaacaattgacaattttcacctttgttatctggtccaggggtgtaaagccaagtgctcacaggctgtgtgcagaccaggatagctatgaatgcaggtcagcataaaaatcacagaatatctcacctaccaaatcagagtgggtgtgcccctgtgtgtatatgcgtgtctgtgtgtgtgtgcatgtatgtgtgtgtgtgtgtgactgttctttatggtaactggttatgtttttctcaagtgaaaaacataactctatacatgataacataatatcccatcatcagtggaaccttgcccaaagaatgtatgaaatctccaggcaatgaatgagggcagcccaagaaagaggcccgcagagccataccacagggctgccccaccctgctggagctcagatcctgccactgctgcaggccctgggtaccaggtgtagagttggaggaggtcttgcctgtgggtctaggtctttggtgcctacctccttgatatggccccagtcctcctttgcttgtttgctagttttatcatgtttcccaggccggcctcaagtccaatatgtagtcaagagtgatctctaactgtgcaacctcctgcctccaagatctgctgagattataggcatgtgcccccctgtctgatttgtgtagagccaggcttcttgtacatgtgacaaccatgccaccctcagctctgtcccagctccatttcttcctttctgaatgcaagcatttactttgtgtccctatattctagaatgtgcaacagtgaagaatttgctctgactttcaggataaagtttgaactaggttcaccatgcttgctttgtccagattgcgactgtcacccagtcctctggctcttccatctgtctgtccactccacctaccaagatgttgaacacttgttctttttaagatgttggtgcctggagtttcattagagtaacacaaaactaactaaaaccaaacaactccaaaggagcccatatgtgttttaatgaaacattttttaagcctattgggggcctgaagagattgctcagaggaaaacagcacttccagaggacccaggttcaattctcatcgctgatgtgatagttaacagctgtaacttcagttccaaggggtctgactttctgccctttgcttgcaatgcttgtatgtgatacacagacatacattctgacaaaatatatccatacacaaaagtatttttttaaaagcttatttgaatgtaagagtatggctagctgtcacttctgataccccttcttatttttttatgactcaagcccttataaactagcaaatagaagtcacagctaccacttgaatataagcacttgaatacctcctctcactagaatacaacatagcttaatagtaaaaatcttgccttagtaaagtacttgcatgtcatgtctacatgaaccaaatgaatgtattaattaataatagacataatgatcacatcggaaaggctgtgagaaataatggagaacatttgaaagctcaggatggaagggaaaggcacttgtcaaaaatcttgacaacctgaatttgacctttggcagggctgaaaactaaacccagggtcttactcccagtaggcatgaacccccacactgagcggcaccacagccctaaggttttaaatggcagaaacaactgagcgcttttctaattcctggtccccaagtcatcactgatggcaaaattcacagcacttcatcttgtctgccaagctggcaagcgaaatggtgtctgatttcttttttgtttttttaaagatttattcattattatatctaagtacactgtagctgtcttcagatgcaccagaaaagggcgtcagatctcattacggatggttgtgagccaccatgtggttgctgggatttgaactcagaaccttcagaagagcagtcggtgctcttaaccactgagccacctctccagccccagtgtctgatttctaatgtttgtgttgaacgtatacattctttgtctgctgttaattctatagtaatctcctgtgaaagattttataacgcccaggcctggattcaaccacaatccaacaggatcggaatcctggggtggtgctcagagatctttttgtgcgtgcattttagttttttaaagtaattagcaggcagcctgcaggacacatctttgccaaaatgtcaaatgctgtgacttataaattaaatatttaagaatgcagcatacccagagaaatcattagatgttcaaagatttaattcgtgtgcaacattaaatgccatgacttgtttaaacaagcacacctaaatattctttcttctgctagaatctgaagcctgtgatgcaggaagcaagaatggagagaatattctagaataagaactttctgggcgattgtgagccctttaataaaaggcatgaatacttatctgtttgaaagagaaatcaatttggggtgggggcgggggttgtcctttctttgctgagttctagcccaacaagccatctgacttgaagactaagacgagcctgccacctgggcaagcacagggacaatgatcccagggcagaggccagctctgctgttttgagaagtgtctaggcaaaagctttctttctttttttttttttttcagaccaaaaggggcctctttaatgtcacacaccattagtgccaccaggtggcgaggttcccttaatttcttcagtatcaagtcttttaaaagtgtatgagtataaacatcttcaaattctcgggtttaaaaacaaaatcaaaaatgaaaaaaggtcgcttacctttagaccataggcaactggagctaaagacaagagataagctggtgtaccccgatggagcagcaggctttaactgaatctgtgaggaacagggtggggcttcacatggtaaaactgaatctgaggtgtgttcttttgcctgtttgggttgttgctgttgttactgctttgttttgtttttttgtttttaagtgaaacagaatttaagtcttttggaagacttttgtaaattctcttggtcccaagggagggctctgtgacgtctggagtctcaacagtttggtctttgccctgtctcctgttattatagactgtggcctttgccactccatcactgcctactgtttttcttggagacagggtctctcccattacgggcagccagcagtgccctgagagtctcttgacatgtggccatgaaggctttttacaaggatgctggggatttgaacccgggttctcatgcttgagccataactgctcttaccctagaactgtctccccagtccaatcactgctactatttttttttcttggcaaatcaattcagttctttagttttctttcaagtattgttttacctatttatcatatttatcactttcattatcaatgttagaaattttgtttagccagcctttttacttattcttgaaataaagggttaaatagatattttttcagttgtgagacatgaaaatcttagaaagaatttttcttttctttttcctttcattttaatagcagtgaatctagaaagagaattatttttcatggtgattatttcaaatgtattgataccattttgtgggctgggaaatgttaaactttgtaaactctgaaacgcacaaagtgttgctttgaatttcaccttaataaaaataacatcaagtatatgcagtgcactttcctctccccctccccctccagctctgcaaggtacagtcatcttttgtctactaagactgatggttctgatttccattgttttatattttcctcttacgtgtgtgtgtgtgtgtgtgtgtgtgtgtgtgtgtgtgtgtctgtgtgtgtgtggtgaactgctctttacacccgtgggctccatgtattcctctgaattatatagtgctgcacacattttgtcaaccgtctgagggtctcagcacttgatcagtgaatgtaacccatttctacttattgtaaaaagcagtaacacaggagctcatttgtatctctttgctcccagtttagctctcactgtgtactctctccccagcctcctagcttccgtagggtaatctgaatgctttaaaggaaatgtcttagtctaatttccagttgctgtaataatacacgctgtcgaaagcagcttaagggagagagagtttcatctgtagtccaggttacagcccaccattgctgggaagtcgcagaggcaggagcttttgagaactggacatagccacactgaagaacagaagagcgtggattaaggcatactcaatagttctcacacatctttatttttatatagttcaggatccacattaactaacacaattaagataatccttcccagacagtctcacattcttggaggtccagcttccaggtgactctagactatttccagttgacagttaaaaccatcacaggtaactttacaactttaaggctttgtttttaagctttttattgagtccctgtgactttcccaccatgcaccccaatcccactcatctctcaccccccgcccaccaaaagagaataaaaaaaccaacaaaacagaaaatatcttgttacggaagctgtagtgtgtcgcagtggttccacagcacacccttttgtccacacacgtttactcgcaaacgttcgttgcaatgagtcattggtctggcttctgctatgctatcaatactggatcctcacagggactcctctttcttatcctgtgtcatggagatcctgcagctttggatctgcaggacaaatcctttcctgcgtccagcagttcatagatggggtagatgttgaggtgggccaactcagagccctggagctgggcctaggtgggagctgagctggccagctcaccagcccttctgcattcacactgccagggtgagctttccagcactggcctggctagctcccccaatgctgcagctggcaaagggcagggtcagctctcccactctcagaccctaggtactggcttacccttgctttcccatcagggccaacacttctgtgccgctcaggtaaggtgcagggcccgctctctcaaaacctgcaaccagttagggacaagaccagctcgctgactgtctcagggggcaaggacggaggggaggagaaggtttgttcttaatacctgatcaatttttcttacaagaccaataattaatttttttcatctaagtttaaatgttattaatcttcgaatctctgactcttatctacctaccctgtacaaacgaaaaactgcaagtttcttgtatttcattgaggtatcttcatattgcggttgaaaccatcagttttactgctattgttgtcgtgattgggagtattgagaacttagactttgccagagcaatggattcctacattgtccggatcgtacatcattacagagttggcactgtagactttattcactaaactcagagataaagaagcaacccagtgagagattgttttcaacccacctctcattggtgacatgggagctctctcgaaactgctccctcaccccagacctgagcaacctctaacaggaaggagagcacctctgaccctattgatctctgaacatggctgacatcaccagtctcttttctatccccgaggcatggcagtactgggatggcaccagcttagggggcgagcctgggatctgtgttagttgctacctcgcttgaaatgatgagtctagcttatgttcttcccaagcttattgggagactcaagagagactacatgtgcaagttcttaaaaaccacattgcataagtgtcttcgaggcattgtggagagcagaaaatactatttcattatagcaattttgaacccttttcagctggcagactttaaggtgagagttgtattcatgactgaagcatcagagcttcttcacttccttccctacttaaagttgtcatttgattttttttttttaaacaaatggaccaaaggacatagaacataaagacccggggaccagagaagttcgatgtgagtgccattctctcttttatgttccatggacaacaaactccgaggagaaaatcgctacacagattacttgtacttgaacatgagcacagacttcattaggaagatgataactaggaccttcctctcctcattatcttttctagaacaggttgtctttaaaaccagcaagaggcttccaacgagcagaacatccacgctctcttagtgacttctgttgctagggcagcacccctgacaacagcacccctgacaacagcgcccctgacaacagcacccctgacaacagcgcccctgacaacagcacccctgacaacagcgcccctgacaacagcacccctgacaacagcgcccctgacaacagcgcccctgacaacagcgcccctgacaacagcgcccctgacaacagcacccctgacagcaaggttgaaaggaagacctgatccctctccaagtctgagactagggtctgccgcgggaaggaagccatggaggatcctgatggaccagatgtcacatgggggacagagggcagcgagtcatgtttccagaggcaagagtgacaactgcttctacccgactcccttcctccattttcctcagcctgggaccccagcctgtgacacagtgccaccctgctcagggcagatcatatgacctcagttaacttaatctagaaaaatctcagctgtccttggagatgtgttcccatagcgattctaaattctgtaaaattatctcgatagaccatcacagcaataacaaaaaaattctctctagctttcaaaatataggattatttatatgtcccttcatgtgttctctcattaaagaactaaaccaaataagtataaaaacataccatattctcttattttccataaattttactaaataaaatatagacagtatttgttggaaaactatggaaagtcattttctacattcttcacatgtagtaaataaacacattatcctttgtaataatatggtagaaaagtataattctctatgttataatgatagaaaattataatagttttatatatgatgatatgttatagataatatagacatacataatatatataatggatcatataagtataataactgaggtctcaatttctatattccaacaaaaataaaaataaattggcttacattaataaaaagactttttaaatttgagacagaatctctttatgtggacaagtgtggacttttactcacagtgatccacctgcttctgcctttcaagtgttaattagtggcaggcgcctaagcctttttttttttttaaagaaccccagaagcactttattttaccacacttcttatggaattggtatttaaaagaattcatcatcaccatcatcatcgctattattacatgtgtgcttgggtcagttctctgcgttcactgtagcttcctgagatagaatgcaggttgtctggcttgcaagttacctttgctcaccatcattagagacttaaaaaaaaaccccaacaacatagtaacactttaagtattttctgtttgtgaagatgaggcacaaaaataagttggtttacttagaaccagttcttggcattttacgtaattgaatgaaaccaaatcagtgtggtgggtagtgggtattaaaacaaaatctcttgtaaccgaggctgggctcaagctcctaacccttctgccacagaattcctaagggctgggactataaatgtgcaccttcatgcctgacattttaaataaaccttggctcaagttttaaactgattgatttaacaatctatagctaatctgtataaaacatctggcttagttattaatcgtgcctgatacgttaaagtcagtctgtagccatctggtcttctataaaattccagaaagctagtcttctgtgcacgtgcacactgtacacggggaaagactgatatcagagttgcttgggtcaaggcctcccccaccacaacctacaaccctaagaagctagacctacccagccatcctcaatagcccagcaagcgccggtgaagcaggtttattcaacgtggccacgttgagaagataaacaggtgtccatcattggagtccagagagaagggttaggtttaatttagagagcaagaattacgcatgactaagcaaccctggtcaagctgagaccctgaccatcatggctgtctgggcctgagtctctcctataagatggtctgacacctagtcagaaggtatgacattttgtagctcctcctcaggctaatgccaggttctcagtctcttccttctctcagtgcgaggtttcttgggaaattccactaacttggagttcattgtctctacagcctgattgccaaagggcaagcacaagtatctcttttagaatctcttcaagaccggaagtaatggcatcccggcatcccgctgcttctccttaacctgcttgggcaggcagagaggccccgtgcacgcaggccacagcagcttaggataagtgctgagttggtgtcattccagcctagccagcagaaggcccaatccagcctgcacttatgcacagaaagcccagagtagcataactctttctttgcatcggggctccttgccaacgtcgaggcgaggcaggcatcctttgtctccctgtgcccgttgtgccccccgttgggttttgatgacagaattatgacagctgctcctcatcgctttactccaccgggaaagctctttgtacatcatcttgtgaaggaggcaaacttccccagcagttggaattcagaattatagtcttacccatccctaatggttcattggcaaggagagtggcattgggatgggcttagatgaaccaagatgacccttccgtgggcagaagatggtgctaagcgtttccaaagtgctgccccggttgcatttctgatgcggtgacaaagtatattgatgagattatctactttagctcagaaatccgggtagcaccgtagtagaacgtcagtgtggaatgaacttaaaaatcatgattcacagtcaagcacagagagatgaacggatgcatgcttgggacttaactgagactctcttcccagaagattctagatcacctcagtcgggtgtgcactctcttcataaactcagggctctgggtgttggaaagatgagaaaatggagtcctagcacaacagtgctccacaaatcagtgtggaagccaaagagatgatccccaaagtgtggcgacccttctggtcatctgccttgtagaagataatcaaattaaggacaactgttccgttttttttcttcttctgattttctacagcagcttcaagtcctgatacattttcaaggaaagattaaatagggttgtgacgcttcttaaaagagatagaaaacactaccgggaagagacagtggttctgaattggatgtgtagctcaaagcaatttgggggaaaatataattaattaaagcaagctgatgtgctcggcttcagttcacagaagcatcatctccgcctggtagggcaattcatcattagtcacaggaaatccagagagaggatgactccgcgctgattggttaggcgctccatccctcagctccacctctctcagagttggcgccaccttctggttggtgactgaactgactccagttaccacaaacacttcaaggtgctctctccaaaggggtgcatcattagctccttggagcataaggtccttcctgacaggtccctcattgctgtttatatcttatttctcaggccagagcttgatggatgagtcacaatccatcattgagtccatctttgcaaagacatgtgatttagcaaacaccttcaacgagagagttttggctgaggcttgtcagtctgagtgagaccatttccttgtctctgaatgcaactcattaaaatcagatgccagcaacgtaatcctccatcgtgttaaaactgcttcatccaagtgtatagtgtgggttcattgtgctccgtctcctgcctctcccccttcgcatagtcctcttgttcacacacacacacacacacacacacacacacacacacacacacacccnnnnnnnnnnnnnnnnnnnnnnnnnnnn

SEQ ID NO: 14 - DNA, 1352 bp, Mus musculus
tgctgggctgcaagtctgcattgggaagtcagacctggacagcagtatgccttcctcaggggccctgaaggacctcagcttcagtcagcacttcaggatgatggtgatttgcatagtgctcctgcaggtgctcctgcaggctgtgtctgtggctgtgacttacatgtacttcaccaacgagatgaagcagctgcaggacaattactccaaaattggactagcttgcttctcaaagacggatgaggatttctgggactccactgatggagagatcttgaacagaccctgcttgcaggttaagaggcaactgtatcagctcattgaagaggtgactttgagaacctttcaggacaccatttctacagttccagaaaagcagctaagtactcctcccttgcccagaggtggaagacctcagaaagtggcagctcacattactgggatcactcggagaagcaactcagctttaattccaatctccaaggatggaaagaccttaggccagaagattgaatcctgggagtcctctcggaaagggcattcatttctcaaccacgtgctctttaggaatggagagctggtcatcgagcaggagggcctgtattacatctattcccaaacatacttccgatttcaggaagctgaagacgcttccaagatggtctcaaaggacaaggtgagaaccaaacagctggtgcagtacatctacaagtacaccagctatccggatcccatagtgctcatgaagagcgccagaaacagctgttggtccagagatgccgagtacggactgtactccatctatcagggaggattgttcgagctaaaaaaaaatgacaggatttttgtttctgtgacaaatgaacatttgatggacctggatcaagaagccagcttctttggagcctttttaattaactaaatgaccagtaaagatcaaacacagccctaaagtacccagtaatcttctaggttgaaggcatgcctggaaagcgactgaactggttaggatatggcctggctgtagaaacctcaggacagatgtgacagaaaggcagctggaactcagcagcgacaggccaacagtccagccacagacactttcggtgtttcatcgagagacttgctttctttccgcaaaatgagatcactgtagcctttcaatgatctacctggtatcagtttgcagagatctagaagacgtccagtttctaaatatttatgcaacaattgacaattttcacctttgttatctggtccaggggtgtaaagccaagtgctcacaggctgtgtgcagaccaggatagctatgaatgcaggtcagcataaaaatcacagaatatctcacctac

SEQ ID NO: 15 - protein, 287 aa, Mus musculus
MPSSGALKDLSFSQHFRMMVICIVLLQVLLQAVSVAVTYMYFTNEMKQLQDNYSKIGLACFSKTDEDFWDSTDGEILNRPCLQVKRQLYQLIEEVTLRTFQDTISTVPEKQLSTPPLPRGGRPQKVAAHITGITRRSNSALIPISKDGKTLGQKIESWESSRKGHSFLNHVLFRNGELVIEQEGYIYSQTYFRFQEAEDASKMVSKDKVRTKQLVQYIYKYTSYPDPIVLMKSARNSCWSRDAEYGSIYQGGLFELKKNDRIFVSVTNEHLMDLDQEASFFGAFLIN

SEQ ID NO: 16 - DNA, 37961 bp, Homo sapiens
ccaagcaaatggaaaagagaaaaacactggggttacaatcctagtttcagacaaaagagactgaaaccaacaaagatcaaaaaagacaaagaagggcattacataatggtaaagggttcaattcaacaagaacacctaactatcttaaatatatatgcacccaccacaggagcacccagattcataaagcaagtacttagataccttcaaagagacttagactcccacataataacagtgggagactttaacaccccactgacaatatcagacaatcaacacagaaaattaacaatacaatacaataagtcttcattaatgttgtcaacaggttcttgtaaactgtaaacttaagtgaaacaacatactgtataccacaggaatttgccttgtttatgtcaattagcctatagtaaaattagttttgttatacggtacgttgtctcacttaaagttgcagtttgcaagaacttatgaatgacgcaagtgaagacttactgcttacatatattttaaagctcttataaatcaacaataaaaatttgaaaagcccaacgacaaaaatacatgaataaacaaatcacgaagaatcattagtcattagggaaataaaataaaccataatgagccaccacttcacatccactacaatgggtatgattttttgttgttgctgttgttcagaaagaagcttcctatatttattaatggaaatttcatgtccccaattaagtattttataacatttgcttagaagacatatgttcaagcaatatatgttttggaaacattgtcacatgatttcaagatcagaatacatctcctgtcccctcatccaccactctcggaagacgttccttttcaccgtggatggaaagattaaacatacacatttcaaacaatatcagagttaaagttatcaatttacaaccagcacgggaataagtacttacaatttcaatgttttgggttgtttccagtcttttatttgcaattcctttagagacagtggtgaatttggaaaatatacatatctccattgtcaccctctttcgtgtccaaaatcttgacttctatccaatttttttcgctaaattaagagttttcattatttcagatcttctcttctccactttaaagttgacattttacatgtcaactttatgtaaaatgtgcaggaatattttacataaagtagaaactatgacttctgtaatttgatagaatttgtctttaaaatttgcagaacatgaccaggtgcagtggctcacacctgtcatctcagcacttcggcaggccaaagagggtgaatcacttgaggtcaggagtttgagaccagcctggccaacatggtgaaaccctgtctctactaaaaatacaaaaattagccaagcatggtggtgggtgcctgcaatcctagctactcaggaggctgaggcaggagaatcgcttgaacctgggaggcggagtttgcagtgagccgagatcgcgagtggctgtgattttttttaaactgccaatatcaagtgttggtgaggatgtgtgggcaatcgaaatacacagattatttattagagtgtaaaatgttacaacctctttgaaaaactgttggcagattttttttgtttgtttttgaggcagagtctcgctctgtcacccagcctatagcccaggctggagtgcagtggcgtgatctcggctcactgcaacctccaccttccagtttcaagctattctcctgcctcagcctcccgagtagctgggactacaggtgctcgccaccacgcccagctaattttttgtatttttagtagagacggggtttcaccgtgttagccaggatggtctcgatctcctgaccttgtgatctgcctgcctcagcctcccaaagtgctgggattacaggtgtgagccaccacacctggcctttaattttttattttttaattgagatggagtctagttctgttgcccaggctggcgtgcagtgatgagaccttggctcactgtaacttccacctccagggttcaagcaattctcatatctcagcctcccatgtagctgggactacaggcaagcaccaccatgcccagctaatttttttgtatttttagtagaggcagagtttcaccatgttggccaggctggtctcaaactcctgacctcaggtgatatgcccgcctcagcctcccaaagtgctgggattacaggcatgagccaccacacctggccagcagttttttaaaaaagttaaacatctacactgtgaccagaaattctattcttcaacacttactttataaaaagcttttgtgcataaaaactttacaaaaacattcaacattactttattcataattatcaaaaactgaaaacaaccctaaagctcatcaatagaagggacaaataaattatggaatactacttactaataaaagagaacaaactactgatgcacgcaaaatagggataaatctcaaaaacattatattaaggaggaaaaaaagccaaaaagtaattacctggagggggttaactggaaaagtgcatgagggaacttttgctctaggactgccaggtttgtaggcctgctgtgtagcaacagactattaccctgacagttatcaatgagctgaaaaggtcccttgtggtttgagctgataacatcccttctggctgtggcatttagcttttgctttgactaaccagcatgcaacttccttccagtgttgaaattttcccaacttgcaaggcagagctcacttctcatccgataaactgaaaatgttagatactcaccttctcatcctcccttgaagctagggtgtgacatgacctagactctgccaatcaggtacataaacacacacgaaacagaagctagtgatgaattatgaagctcatgaattatgaagcagaagaaggcactgagcagattctgttctgggggttttgtccactgactactgtattcagtttccagaaacagcagtgtcactggttctaggagcagcctctgatggctagtgtaggtggcaccagtgttgcagctgtgacatgtgtatcccatggtggaagcagttatattgctaccaaagtgactgtgtgtatattcagtttccagaaacagcagcatcactggttctaggagcagcatctgacatctagtgtaggtggcaccagtgttgcacctgtgatatgtgtatcctgcagtggaagcagttatattgctatccgagtgactgcgtgtgtattcagtttccagaaaagcagcatcactggttctaggagcagcctttgatgtctagtgtaggtggcaccagtgttgctcctgtgatgtgtgtatcctgtggtggaagcaattatattgctaccagagtgacagtgtggataggttttggtgattctggatttgacagctccaaatctacgtttacagcaacctcagccgccaccaagattcaaacaaccccatatccttttgataaagtcatttttctgtttccatttgtcggaattggtgttagtcgcttgacactaaaacactacttgaaatttggttgaagctatcttaagtggcgttctttgttaattgtagctgaatgtatttaaataatccccagtcctaagctctatcagttttctattgccacaataattatttattcttgctcacttgtccatgggttgcctgggaatcagctgatctaggctgtgttgagctgactttggctccaaaatgtggactgggtctatctcagctccatgtatctctcatcctccttggactacccagtgtttgtcttctcatggaaataacagagttggacaagaccaaccatgaaattttaatctaagccttctcatgttaggtttactgatattccaatggtcagatcacattaccaagtcccacatgggtgaagaggggatatatactccttatatactgatatgaactgtgaagccacatggcaaaaggtatgaatagagagatggatgaagaattggagaaaataataagatctaccatattaacctataccccaccccatcctccaacataaagaaagaaacacttaggtagtgactactgttggtataattgctgtttttttggtttgtttttgtttttttttgagacggagtcttgctctgtcacctaggctggagtgcagtggcatgatctcagctcactgcaacctccacatggcctgatataattgttttaatagctattgaagtcttctcagaagatgctgggtgtggtggctcgtgcctgtaatcccagcacttcgggaggctgaggcgggtgggtcacctgaggtcaggagttcgagaccagcctggctaacatggcgaaaccccgtctctactaaaagtacaaaaattagccagatgtggtggcaggcgcctataatcccagctactcgggagactgaggcaggagaatcacttgaacccaggaggcagagattgcagtgagccgagatcacatcattgcattccagcctgggagacagagtgaaactctgtctcaaaaaaaaaaaaaaaagctgttatctccaaagagtttgtaaaaagtggacagatactttgtattgcttaagaggactcacctggcagcagtttgccctcttcattctggaagctcagttgtcccaacacatatgagattactagcctgaatgagcagctattgagtggtggagtatggatgctcgggcagaagtgtccaaacacatatccaatgtcatatctagtgtgatggggggaggaggaataaatgatttgaggaatacagaattgtttttgctccaatatagtgtggataaaatagccaaagtttagagcaatttacctggaagcaaatagatgtgaattctagtcattctgccattttgtaattcaacaaccacgactaactcacttaacttttggtgctttagtttccttatcaaccaagcaatagaattttcctgggggtctttaagatgtctaacagtccagtcattttatgattctaccattgtctgattataaaaataataggatttggctgggcgtggtggctcatgcctgtaatctcaacacgttgggaggccgagacgggtagatcatctgaggtcaggagttcgagaccagcctggccaacatggcaaaaccccgtctctactaaaaatacaaaaattagctgggtgtggtggcacgtgcctatagtcccagctacttgggaggctgaggcgggagaattgcttgaacccaggaggcggaggttgaagtgagcagagatcatgccactgcactccagcctggtgacaaagcgacattccatctcaaaaaaaaatttaaaaaacaataataatagaattcatttcttcactcaaagacagtgtgtccaagacctgacaagacttcatttttatttttattttactttttatttttttgagtctacgtgtcctgctcttgcccaggctgaggtgcagtgcatgatctcagctcactgcaacctcctcctccgagcctgaagtgattctcctgcctcagcctccggagtagctggaattacaggcacgcaccaccatgtccgtgagccaccgcacgcgcccagcctaacagctcttataattaaatccttacttcagaagaaaagttttaaaatctttaaaaatcttcaaaaatcttcacagggcaccagtggcagcaacagcttctgtttttcccttcatgttaaaagcaaacaaggatcaactattggcaaaattaagtgctggaagtatagatcttttagagaaatacccagccttatagtcccgaaaccttttcctgcatctctgcttgaggaatgtacagtcttctcttcacctcctttgtcccttggtctgattaggaaaacaatccaagcctcccagtgtggttacttaaacttactttaacatttacattttaactaacatctttattcacagaatgaaatatttggcacttagtctagggatgtcatgcactaggaaacaagtaatagatttcttgtaaggcttggtggggaagacttaacaattctgtgtctgtgaccattctgcagaacacactgctgctcctgaggtaaagagccttaagattctggagactatgaaatgctcattcatccaaccagcatagatcgtgctcacagtgtgcaaggcattggtagcaatgcatgtggcaaagtttcactctcatgcaacctacattcttataaatggggtagccataaaataaacaaataagtatagaaacaaacaagaggctgggcgtggtggctcacgccggtaatcccagcactttgggaggccgaggtgggcagatcacgaggtcagaatattgaggccatcctggctaacaaggtaaaagcccatctctagtaaaaatacaaaaaattatctgggtgtggtggcatgcacctgtaatcccagctactcaggaggctgaggcaggagaatcgcttgaacccaggaggtggaggttgcagtgagcggatacggcgccactgcactccagcctgggggacagagtgagattctgtctcaaaaaaaaaaaaaaaaaaaggaaacaagatacactggaagttctctaaccttcagtcagtatgttccacacagggaatgaagaacttaggctattcttctgtttccatctatatatctaacaagaattaaattattctcagaactgattatgccagttgtaattacatagttcatataaatatcatggaagccaataaaatatgagttgtttcttggaatgctgaatttaatgctttgtaaggacttcattaaaaattacttaaaaattataaaacaggccgggtgcagtgtgtaatcaagcctgtaatctcagcactttgggaggctgaggagggtggatcacttgaggtcaggagttcaagaccagcctgaccaacatggtgaaaccccgtctctactaaaactacaaaacattagccaggcatggtggtgcacagctgtaatcccagctactcaggaggctgagacacgagaatctcttgaacctgggaggcggaagttgcagtaagccgagatcccaccactgcactccagcctgggcaacaaagtgagactctgtctcaaaaaaaaaaaaaagtatttttaaaaggttctcagccgggtatggtggctcacgcctgtaatcccagcattttgggaggccaaggcaggtggatcacctgaggtcaggagtttgagaccagcctggccaacatggtgaaaccctgactctactaaaaatacaaaaaaaaaaaaattagccaggtgtggtggcgggcacctgtagtcccagctactcgggaggctaaggcaggaggaccacttgaacccaggaggtggaggttgcagtgagctgagattgtaccactgcactccagcctgggtaacagagtgagactctgtctcaaaataaataaataaaataaaataacaaattctcactccagtttaaagaaactgaattgctgattaaaggttatggttaatgtatggatgccagtcagcagatccatgctagtaataataataataatggctttagctctatattatttaaacattgttataacaaaaagattaagatttctctatatcaaatatgtatatataatatcttcatatttaatacgttaggaggctcaaagatagaggtagccagacctcttgacttttttttttttttttttgagctggagtcttgctctgtcacccaggctggagttcagtggcacgatctctggtcactgcaagctctgcctcccgggttcacaccattctcctgcctcagcctcccaagtagctgggactacaggcacccaccaccatgccctaataattttttgtatttttagtagagatggagtttcaccgcgttagccaggatggtctcgatctcttgacctcatgatccgcccgcctcggcctcctaaagtgctgagaatacaggcgtgagccaccgcgcccagccgactcttgtaactcctcaaatcaccccatctcttgacctgaccccgagataagcctccttatttccacactctagactttcttacgtgcttataagatagagatgttgacttcctgcacgtttcccattccttcgtttcatgcctttcacgtacatcatagccgtaatgtttctatttctggattataacaaaggtgttaagttggttttctttggtcttctcccctgtgtttctctgccatctctcgtttcttgtttctgccctgcccggctgtgtgtcttgtgcattacggttatcctactcatctttcacctgatttaaaaaactcattcagtctaggacttagagtgtaagtgtgttcaaatagtgttaggttcacataatgtctaaaacttttagtaggaaaaatgctaccttgccaatttgtctgtgtctgaaaggaatttgcatttaaaaatttggcaatttgacagaggcaaatttaaaatttgaaaatattttcttaaatgtagactcatttacagacagaaggcaagggcaggaagtgatggtgaccagcggtgcctgaatgaactcaggaatgtaactgtagatctagggtcccaaactttaggtttcaaaggatctcttggagtacttgctgaaaaatgtaggttcctaagtccactgccagaaactctgactcagtgggtcaagaatggaataactaaacaatggccccatgcagtggttcatgcctgtaatcccagcacgttgggaggttgaagcaagaggatcacttgaggtcaggagttcgagaccagcctggcctacatggtaaaaccccatctctactaaaaatgcaaaaaaattagctgggcatggtggcatgcacctgtaatcccagctacttgggaggctgaggcaggagaattgcttgaatctgggaggtggaggttgtagtgggccgagattgtgccattgcaccactgcactccagcctgggcgataaagtgagattctgtcaaaaaaataaataaatacatgaaagagagaaagaaagaaagaaagaaagaaagaaggaaagaaggaaagaatagaaaagaaaagaaagaaagaaagaaaggaagaaaaggaaagaaagaaatgctgaataagatatagagacaacatacagctgggccagcttatgacatctgatagtggggagatttggggctgggtcctgaatctgagggtaattaactccctgtaacttcttttcctaatctgtaaaaggatagtgacagcgagacattgtgatggggttaatattttggaaaacatccacatgtttttttcctttgcctttctgagtgtgtcaactacttcctacctgtccagcctaacacacaggcatattgtcttggtagggatggagatctgagaaggagattagaatttgtgtctgaaggtttgcaaagaggaagaagtcgtcaatatttagattctgacattcaagatggaattatgtagcaagaccattgctatgagacagtatttctattttcctttatccactcccaccctgccctcttcccaccctcacagtagcatgagaaaaaccacatatggaagtttcaggtcataaaaattatcttataatttagaaaacaggccttgtgcctatgacagccaggccatgaggcttagagctctgtggtagaatgaggatatgttagggaaaagcaaagaaaatccctcccctctttggctgaggacattatcaaaaggagagcaagaaagagaagagagaaatgggcttgaggtgagtgcagataaggggtgcatggatcctgagggcaaggagaggagcttctttcagtttccctcctttccaacgactactttgagacaagagctgtccctgggcagtaggaaaggggagggacagttgcaggttcaatagatgtgggtggggccaaggccacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcaggtcagtgcagtgcagtgcactcagtcttcgaggcgcttagcaaatgtctggttacctgcttctttgcatgtcagcttgcccctctctgaagactttcctgcttcctttctctgtgggtacactctaactgctaaatcacataacaactgaggtctttgcaaaactgtaagttcaagaaattgtgtaaactaagtgcagttacacaactggcttcactagttactagcagatgtgggcaacaaaactcctgagggattttttgtttttaaaagtatgtgtattttataatatcagccattgcaactcttcatgaaagctttctgctaaatgctttgtagttcttttgttttccttttccaaacttttatttgtgcacattcaattgaaaaagataatttttacaggttctttggtgcccattttcagcatacaaaaatgtaaaagactattcacagataaaacacattagctcaaaatggaaaaaaataacaatgacaacaataaaacaacctaaggtagtgcacactgtgacagctctgcttatggggacatgagaattcctgcgaaaataaatagaatgtccttttgtaaaagcagcaatgacatgtcttgtaaacttccttttttatattataacaaggtttggaataaaatccaaagggactggagcttacactgtagccatgaataaataaaagagtctatttcctcaattaccgttggttcagttttccttttgagtccaatgtgcagcaggttttaaaaggtgcacagtaagagattctaaccaattaagtggtgaatgataaaatttctttcctgctttcaaacacaaatgggtaaatctgttccacagcagtagcaacagcctttaaatagggccttgttactgtgatacttcctgtcgaaaaaatctgtaatgtagctcttagagtctttatccaatagcacacagcaggatgaagttcagattcataactcacatgaggtctattgctctttgtgaattctggcaaacagatttctttatttttaaatttttttattttactttaagttctgggatacgtgtacagaacgtgcaggtttgttacataggtatacatgtgccatggtggtttgctgcacccatcaacccatcatctaggttgtaagccccacaggcattaggtatttgttctaatgctctccctcccctagcctcccacccccgacaggccccagtgtgtgtgttgccctccctgtgtccatgtgctctcactgttcaactcccacttatgagtgagaacatgcagtgtttggttttctgttcctgtgttagtttgctgagaatgatggcttccagcttcatccatgtctctgcaaaggacatgaattcattctttttaatggctgcatagtattccatggtgtatatgtgccacattttctttatccagtctatcactgatgagcatttgggttggttccaagtctttgctattgtaaatggtgctggaataaacatatgtgtgcatgtgtctttatagtagaatgatttataatcctttgggtatatacccagtaatgggattgctgagtcaaatggtatttctggttccttgaggaattgccacactgtcttccacactggttgaactaatttatactcccaccaacagtgtaaaagcattcctatttctccacatccttccagcatctgttgtttcctgactttttaatgaccaccattctaactggagtgagatggtatctcattatggttttgatttgcatttctctaatgaccagtgatgatgagctttttttcatgtttgttggccacataaatgtcttcttttgagaagtatctgttcatatcttttgcccactttttgatgtggtttttttcttgtcaatttgttttacaagaaacaaattccttgtagattctgcatattagacctttgtcagatgggtagattgcaaaaattttctcccattctgtaggttccctgttcactctgatgatagtttcttctgctgtgcagaagctctttagtttaattagatcccatttgtcaattttgacttttgttgcaattgcttttggtgttttagtcatgaagtctttgcccatgccatcttgaatggtatgcctaggttttcttctggggtttttatgcttttaggttttacgtttaagtctttaatccatcttgagttaatttttgtagaagctgtaaggaaggggcccagtttctgttttctgcatatggctagccagttttcccagcaccatttattaaatagggaatcctttccccattgcttgtttttgtcaggtttgtcaaagatcaggtggttgtagatgtgtggtgttatttctgaggcctctgttctgttccattggtctatatatctgtttccataccagtaacatgctgttttggtaactgtagccatcttccctgctttgttgttgcaggttggagttacagttcttgactcatgaattcttgagggtgagggtagctgtatcagagctgtgtctgcttctgctcatcagtatacctctgggtctagcatgtggttcccaagtagccactaatactaatacttgtggttcactacatacttattgcgtgaatgaacagccttcacagatgtggtaggcaccacgaatatgcaggcgacaagggtagagtcaggctcaacccaaagccaggccctaagtcactgaacactcccgttttgtattccagatgtagctagtcctggtgaactttcacatctttgaaatgttttgcttttagttatgtggcattcctgtgttgacaataagtgagaatacaaaggactggcattctgcctattcctggggcacgggcatgtcatgggtaaaatctgtaataaagaagttatcagatagacacagctgttcatgataaaacaattgaaaagcaaactgccaatctctgcctgtggatggtccatgtacaaattgaggtatctttgacagacaaaacaaacaaacagtgctattttaatttatgattttctcgatgaaaacccctggaactatgactgcaaaattgctgaaaataaaccaactcagtttttgacttctaatatatattttaattcattgtatattaaatagtagagaattatgagctacaaggaacgtcagatcctccccccaccaccacaaccactttttacagacgaggagacaagaaataatgtactcaagttcagacaaggctttggaggctggccgtggggcggctagcacccaggtctgtaggctcttccctccacagtgggatgtccacagggttaacctatctacaccttgtgatgtacactgtgcatgcacagcgcatcctgcagcaccaactctgccagctgactaggaaatgaaaggctaaggatctcagaaaagtataaattgtgcaaaagacatagagtagtaactatttgctagggaaatgtagtttgcatatcctgtggaatgtaagtttggttatcccaatcagtcggaaatttttcttttggaaatggatgaggcagactcttgttttatttgcaactaattatgaaaattatggctactattagatgaccagtaaagtcaggtttattgtaggacacatttagaaaagattttcttttgtaagaaaaaaatattaatgaaactgtaatcatacctttagctttaagtctacacgagagactggaatactgctatgttcaccaatttggagccagaatttcctaacctttcttaactttgcagcataaacagagtaaagctgttactccacacacaagtagctccatcaatttgcttacattacaagttggactaattttaagattgaatcaaccagttctttactcaactgactcatgcaattgtctgtatatataatcaaatttctttttcaattctactataaaaatggaaatttcatataaggcttaagatcttcccacttgcatacatttttcctaattgcatattgacatatgaacacatgtacattaggcatgcagaagaattcattgagagtgctagaaagctaggagaattacagatattgagcaattactgtgtaccagcaactttgaaaagtattgcctggtttcaattctcataacaattctattatgtaagtataattaccccatattacagatgaacaaactaaagctcaggcgaagttaagagatttgttcaagattacaaaactagtaaaaggtaaaacctgattttgaacccaggcatgaaggaggtactcaataaattgaagcacctacttttttttacaatacattttttcaatacaatacaatgctatttttatagtagcgttctaattactgctgaaaagtctcctgaaggtgtcactttcttcatcagaaattttccaaagggaaaataagtttgaatcttctgtgtagactttggaaaagtatattcaacataagtattaatttcttaaaattgaatacaggctccactttgtctggtgaacatttgcagaagatacactctgcaaggattatagggtgtaagggttaaggaaggcttcataacattggattggaccttcaccaatagcctgtagaccagcaaacatgaacaacaaatatgggcttagcccctgaaatctgtgtccctctgagaaagttttatgataaaggaatggcctgtcactgtgacatcatagatggggaggaaaaaggagaagggcttcctctccacggatctccataaatgatcctttatgctatttgcagtttgcagaaaatgattgccagagactaatgtctgggcagcagacagggtcattgctgccatcttgaagtctaccttgctgagtctaccctgctgacctcaagccccatcaaggactggttgaccctggcctagacaaccaccgtgtttgtaacagcaccaagagcagtcaccatggaaatccacttttcagaaccaagggcttctggagctgaagaacaggcacccagtgcaagagctttcttttcagaggcacgcaaatgaaaataatccccacacgctaccttctgcccccaatgcccaagtgtggttagttagagaatatagcctcagcctatgatatgctgcaggaaactcatattttgaagtggaaaggatgggaggaggcgggggagacgtatcgtattaattatcattcttggaataaccacagcacctcacgtcaacccgccatgtgtctagtcaccagcattggccaagttctataggagaaactaccaaaattcatgatgcaagaaacatgtgagggtggagagagtgactggggcttcctctctggatttctattgttcagaaatcaatatttatgcataaaaaggtctagaaagagaaacaccaaaatgacaatgtgatctctagatggtatgattatgggtactttttttcctttttatttttctatattttacaaattttctacagggaatgttataaaaatatccatgctatccatgtataattttcatacagatttaaagaacacagcatttttatatagtcttatgagaaaacaaccatactcaaaattatgcacacacacagtctgatctcacccctgtaaacaagagatatcatccaaaggttaagtaggaggtgagaatatagctgctattagtggttgttttgttttgtttttgtgatttacttatttagtttttggagggttttttttttcttttagaaaagtgttctttactttccatgcttccctgcttgcctgtgtatcctgaatgtatccaggctttataaactcctgggtaataatgtagctacattaacttgttaacctcccatccacttatacccaggaccttactcaattttccaggttccttccacctcctcctgaaagtatttctggaaaatactcagaagggatcacaggctctagccagcaattggtgctaacctgggctagtccctgtggcacaagctccaccaccaccatccatgtcaaactccacctcagttgataagttgttgcctgctgccattactgcctgatcacaggcagctttcaactctgcaccttgcctctcacagctgaagcctcccatattcagccatttcctgctgagatagcttacagctgatgtgaagtgaaaaggcataccgctccctcctttctgtgtcatgcacaccttcttgccccaacaagttacagagacttgtgagcctgcttgttcagtgtaatcaaaccgaagcttggccagagccaactcatactgagtgaactgggacagtgtccagggaaagtttgctcttcctggaaccaccctcgggccttgtggctgatcccagtttctcgtctcttccttcttgatcctttcccacagtttgctagacatgctctcatatttctgaatcatatgtgactgagtgccttccttggaaaggttttgcatctcccaagtcaattcgaggtgcaactggatgtttacaggtggggcaggcaggggcaaggaaatgtacctaagtccatggccagtcatatctcaactcaggaggccccagcttcacctccaactacatatactacgggaatgtttttctcttgtaatttaaaagaggaagaaagaaaataaacatttgtttaaaagtaaatgaatgatctatgtcagggtgtgtggaagaaatttattaactcaagtttgcacctttgcatttgagggaccttggccaaatgtccaagggttacatggctgagtacagaactgtgtgattctagctgggacctctcataaacagttaagatattttgatttaaaatgatattgtctttctataggaaggagtgaatcatcgttcaatttgatcctcccttcaacctttgcagtaccttagttcaaataacagattaaaattgtcattttctcatttatttccctaggtagtcaattcagcagatttttttttttttttttgagatggagtctcgctctgttgcccaggctagagtgcaatggcacgatctcagctcactgcaagctccgcctcccgggttcacaccattatcctgcctcagcctcccaaatagctgggactacaggcgcccgccaccacgcccagctaattttttgtatttttttagtagagatggggtttcactgggttagccaggatggtctcgatctcctgactttgtgattcacccgcctcggcctcccagagtgctgggattataggcatgagccaccgcgcctggccaattcagcagattttttcagggaaataacgtctcttccatcccacttgttaaaacaaaacaaaacggaagagaagaaatgagcaaagcaaacaaacaaacaaacaaaacccttctggctttgtttggaccttctgtttcctgtttttctcaattaaacaattatcagcctaaagagttctgggtggtttgggatggggtgtgtgtgggtgtgtgtgtgtgtttataacatcaagcaaggatttgttgatgagggtgaggagctcgttgataatgatctgactattgccattgtttactttcaatcagaacagggagaaaaccttcaaagagtgtttaaggtctctaccaataaatccctagttagtgtaaacatttaatgagacagcattcagatttctagtggcaacatggtccagattttgccagccagaggagtagaaatcagatcagtaactagaatctatttagctagccacagctagaaacagaacatgaccccctcccaaatgacttggctgttttttatttaggatcctaaaatgtaaactgactccactaccgaccttgtatctaggtaggtttccagcttcaaaatgggatacataccatggcagaactggaagagacctcagaatcaccatagtgaaccggctcaaaactataaacagacacaggagaatggaagcaacttgtcaagaaaagcacagctgtttagtaagggaggcagggaaggacactgtgactccagatgcctgaagcacacctgcatcctttccaccatatccagctgcttacttttattctttttttttttttttaaggacaaaggagagcatgcttacttttatttcaaacaggaacttactcaatatgccaaaacttctttaagtctgctatcagtttctgttgtcttaacttccaaatgaacaaaaataaaaagcacttatgcaaaatattgtgttatattccatctcaacccagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaaggtaggtaacctcaccaggtgacctcaccagcaggcggagaaggccagaagaattccttaaagcaaaggaatctttaagataatcaagtctagactcttcattttacaaataagaaaacttaggcccagagtatttaagtaattttccccaaattcatagaactaggaaaatggggcatagcagcaaagggcaggacctggccgactcctggtctagagttcattcctctgccccggacagcctccacatctagtctaaccttttgatctcacattatggaaactgaggcacacacagggtaatgaagagaaggtcacaaagtcataaagaatgtgtggcattgtttttcattcaaaagataaagaagatcaaataatgatattttatattcttcccacattgctgatgtctggaattaaatatttgtttttgtatgcatatagagataaagaaagaggaaaataagaggaaagaaagaggaaaggaagggaagggaagaaagagatactttgagaaattgaaggtggttttttcttaatttacagccaataaataacaaattacaaaaagtatctgtttatggaagttgcttaaacaggacctccagcagagacatgttagttaacagtttattttactaaatgtggcagagtgacagatctaatcaagtttcttctcttaggctcttccttctttataagatggcattaaataatatttgcagccgggtgtagtggctcacgcctgtaatcccagcactttgggaggctgaggcaggcggatcacctgaggtcaggagttgaagaccagcctggccaacatggtgaaaccctgtgtctactaaaaatacaaaaattagcaaagtgtggtggtgtgtgcctgtactcccagctacttgggaggctgagacaggagaactgcttgaacctaagaggcagaagttgcagtgagctgagatcatgccactgcactctagcctgggcaacagagcaagactctatctcaaaaaccaaaaaaaaaaaaaaattgcttctgcctatgtgaaaatatcagatgagaacacagctataaaaatactctgtaaactatgaagtaccacatacaccaccattgtttaaagacgttaactgggggaattcccagggtaggaggagaatgtgttttacacatgtttataagtccattgtttggtgttctgcatctgtttctccatataaatactgttatgttggtggttagggatcaagctgataatcctgagctgttttcacagtagagccctgacacatgtgagatgctatttctatgggaaatgaaactagacttccttctaggagtcctagaaacatacctgttctgtggctgccctggcggcattgctccagacaggggggcccactccacacaagctgtacggaagcagctatgattccaccactgcaaatgacagcaagtgttcagggggcaaggaccaggagactaggaaaagcctgggctggagaaaggtcctgaggaagctgagaaatgaaactcccaagttcccgggataggggcttggggagggtggaggtgcgattgtccagcagggcagagagactgagaactagggtggaaatctggagactgaggagagggctgggtgctgtggacagggagtggggagataagagaaatagtgaggacatttctctttcctgctattcctgccattctccctcccattctcacatcctgctaccaactagaatagcgggaagctgggagagaacacagagggaataggtgagaatgtgggaaaaataattctctttttcttttcaggcacattagttgaacagatttattccagtaaatatcctatgcccatttcatacattatctcatttaatcctcacgacagctctgaataataaatcgttattatcctcttaaatatattttaaaaatagattaataaattgaagtttagatcagttaaataacttgaacagtctcacagagccagtaactgaaacatttgaatgcagggcatctggccatgcttctagtcactctttttattttgcctcccacattgtaggaaagacccttttctttttcctgttgcttccccttctttccttcctttctgttgcagaataagagaaagagagtaagagtgggaaagagagacacacagagagaaatgagaggcagagataagagagaatgctgtggtttcctctcacttccccttcccgtaagtcagtgcccagggaactgattacagtcagtccaccgccaccactccctgcccccattatccggcatcagggcttgcggtggagggagaagcagagagcttctgctttgggctggaagtacagagaaggcaagtttctgacagttgcaacattaactacagtgactgagaaagagggcagtgatgggagaaggtggcaggagggacagagctgaattcagaagccatggatgagccaagtcagggtcttcccatttaatagagaggtttggttttcactctttcttactggttttccccactggttagtacaaaggctgggggaggttactagatatttagcaaagatatgggaagatggtaaaatatctttatgttgagaatggctcagccacattctcagaagtgaaagaatgacacggtgttgtcaggttatacctcgataggctatgtatgtctgtgggcatcctgagagagaggaagtgtgccctgcatcttgaggcttgggtctgtccaataattttaagcccctgggctctgctacccagtgcacttatacacacacacacatgaatgtgcacatacatacaccccacacacagaaagtgacatgacatggctgccacacccatcagccacatttggctgacatcacatggcggatggcttcttcctcctgcactgctccaggtgtggcctttccaagacttcatccagcaacagaacttcccaggcaggggaccatcccttgattgctgtgctgggacagctatctcaatatttatcccagctcccaccccaccccttacagaccctatgcttgaccaacttaaaacttcccagattgataatgcatgtagaaatttcctgttagacatcagcaagatgagccataggcattctatagtcagtttaaatttttagggaaattaacaagctttattcaataatatttgcagatgattttgagaacctctgaggaaaccatttctacagttcaaggtagtatcttttttgttgttattttaattttttactgtcatcttcatgacaggttgtgaatagttctccattctccttctctgtgttctcatccactcatccatcctctgatctgctgctccgtatctcaagccacttgttgattctacttccctctttacattggcagctaggaagctcagaaccaaatctgtggcccatctatggtcagaactttatttcaacttaattttattcttccccatgaattttcctttcaccttaatttcttcacttattagtttctaccttctaatgtgttacaaagaagccatcttaaatcgtttctgggaaattgagagaaataaatgaagtcccttaaagttacccttctttgtttcaggccaccactgggctccaggtctttctttacaaaagcctcctcctccatcatccttttcccaacaatctttctacccacccacgatcctcatcctgcggtctccacctgtggccacaccaccctcttgttcatggtcagcagccttctctcgacccacctctctgtgcactactgttgcccaggctggcttctttagctttccatctggcactccatcgtactttacagctcacgtaattgtcacctcttcagagagggcttccctggacacctttctaagtaaattccctgcactctgttatttttatcacatgtaccttgttcatttcctttcagttatttttttaaatctgttattcttttccaatgcaataaacttcttcatcacttggcacccccattttcctttattaaatatgttttcttaaatataaaggacaggacctgttcctggggtctaagccttctttcttatcatttctccaaaggtgaaagcagtagtgagaatgttgaacactccacctattcagatgaggcataccagattaatggtctacagcagatagatgcatgtactgttttcagtgttggaagaataaaattctttgttattcatcccagtaaggtgaaacacaactctgtataccaagatatatccatggtacctcgatatacatatttgcaggtttcttttttgggaggtgtttgctataaccagttggaaatttcctcttttaaaaatttgctttcaaatctaggctttcctatccatatccttgaaatgaccttaacaaatctgttgcccaggctggagtgcagtggtacgatcatggctcactgcagcctcaacttcctggcctcaaacaatcctcccacctcagcttcccgaatagtaggactacgggcacaggccaacacgcctggctgatttttctattttttatagagacaaggtttcactatgttgcccaggctaatctcaaactctcaggctaagtgatccacccatcttggcctccaaattgtcactttctaattcatattttctgtagaaggctgtaagtcccttgaggacatggtcagtgaaatcagtgattaatatttgtagccctctggggtttagtgccttaccctagcactgtctgtttgatgaaagaatataatttacttacaaccaatgtaagcacacttgggaagtttgaactgattcttttagagaaagtcatttgttacatttctttttttttttttttttttgacggagtcttgctctgttgcccaggctggagtgcaatggtgagatctctgctcactgcaagctccgcctcctggattcacaccattctcctgcctcagcctcctgagtagttgggactataggtgcctgccaccatgcccagctaatttttttgtatttttagtagagatggggtttcaccgtgttagccaggatagtctcaatctcctgaccatctgtttgttggtaccactctgtttatttctgtatgtaattcaaggtggaaatttgccaatacgtagttatttgcacaatttaactcagcaggattattacacagctacagctatttctttatttatatttttggaaaagggatagaatcttcactttgttgtatcttcactttgtttctctttggaccctacccgtgagacactaataaattataatccatgttactgcttattctttccgtgtaaagtacttttcaagttgatcataagctgaggtaggttgatcataatatcaaaatgttatttttatgaaaactcatagaatcaactttggaagcccagtatgcttacgatggctgattgacaacacctatgaagagcaaggtattggagaactagtttggcaagtgttgatgaccctttatcatttctcttttagaaaagcaacaaaatatttctcccctagtgagagaaagaggtcctcagagagtagcagctcacataactgggaccagaggaagaagcaacacattgtcttctccaagtaagagaaacaacaaataagtgacttaagggaaaataatggaaggattgtgccaagtaacttattttttaaagaattttatctgaaatgtttatatggctatctacaaaatgctcagtattaatcagatctcagattgactgttttcagatgcaagattacagacaaacagctcaattattgccacgacataactggcctcaggaaaattacaaagtgggagaattttgtctttgcagttttcaggatcccattttttttccttctttagagtaatttctcgctctttctttctttctttttctttctttctttcctttttttttttagacagagtttcacgtttgttgcccaggctggagtgcaatggcaccatctcggctcactgcaacctccgcctccagtgttcaagcaattctcctgcctcagcctcccaagtagctgggattacaggcacgcagctccacgcctggctaattttgtatttttagtagagatgggatttctccatgttggtcaggctggtctcgaactcccgacctcaggtgatccgcccacctcggcctcccaaagtgctgggattacaggtgtgagccactgcacccagcctttctctcttatgattacttcttccatccctctgcacttctcttctttgctcgccatcaaatctcccttctctttaaaggttctaaatcatttactatccctatgaatcactaggtgctcctagtggcatttacattaaattaaaccacaggagattgccaatatttgaccatattttacttacacaaatgtcagtttcatatagtttaaccatatatgttacatctaatttatatataggcagaacatgtgtcgatatgttgctatgtaatactgtgcatgggtatttttttgttttttttttgtttttttgagacggagtttcacttttgtcgcccaggctggagtgcaatggtgccatctcggctcactgcaacctttgcctcccaggttcaagcgattctcctgcctcagcttcccgagtagctgggattacaagcatgcaccactacacgaggctggtctcaaactcttgacctcagctgatccacacccccccggcctcccaaagtgctggaattacaggcgtgagccaccacaccaggcctctgtgcatgggtcttatagtgtaaatatctaggttggaatcacagctcctcttcacctagatgcatgttttgagctaattacttaacctagtcaagcttcagtttcttcatgtgcaaagatgagacaaatcttaacccacaaaatgatgcaaaatgtctggtctattgtatgtcctcaagaaatactcacctttatttttgtcagaggctttatcccgtaaatttgtctaaaaatatttcagacatcagttaatagataaaaagtttgtttgggggtttggggttggttggttggtttagtttcttctgggtagttgccttcttgacattcttggactcatgttttataaatgattgtcatgttctgcctacaagtgaggggattattatgatgttactgcttgctactcatcaataaatataactggtttacgctctggaaaagcccaattttgcaccaatcgtggagataggctaaaagtgtaaatgaatatcattttggaaggttcatttttcattcaaaacctttgagtgtgaaagattcaaggatctgaggatctttaaatctaggctcctttgccaactttgtgcctctattatttttggctagagacgccatctgcttggatgtgcctttgactctggagagctgagaaagatcaaggggggacccaaagagtccaaaaggaatggcaagaacttctgagatttaggcctaaagaaatagatacgtttatttcggtttccttctggattgtccacttaagttcaccagcacaagacgggaggaacagattcagggcagaagttctgcccaggagaaaccattgctatctgagtgggccatcccttgtgctaccattctaagtgtgacacatgtggcataagcagctgacaaggtataaaaagacaagggactcccaacagttcccaatgtcacaatgatgcaggaacctcccaatttctatgtgactagaatttataatccacattaagattgaaggaggaagaagtttgatattagattgaaatccctggcaagcccaacaaaaatataggctggccacagctgcaaaaaagctccttgctttgctacaaattcccttctgttaacgctctttctctctaaatttcctacagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatgatcaaatgtatcagttcttttatttatggctaatacctttgttctgggttgagttgtgctgtgtcctcaggaaagatatgttgaagtcttaccagtacctcagaatataaccttatttggacatagggccattgtgaatgtaactagttaaggtaaggtcatactggaaaaggatgggcccttaatacaagatgactagtattttttttttttttttttgagacagagtctctctgtcacccaggctggagtgcaatggcttaatctcggttcactgcaaactccacctcccaggttcaagcgattttcctgcctcagcctcctgagtagctgggaattacaggtgtgcaccaccatgcccggctaatttttgtatttttagtagagatggggttttgccatgttggccaggctggtcttgaactcctgacctcaggtgatccacccccctcggcctcccaaagtgctgggattacaggcatgagccactgcgactggcccactggcatttttgtaagaagagggaaatttgggccgggcgcggtggctcacacctgtaatcccagcactttgggaggccgaggtgggcggatcacgaggtcaggagatcgagaccatcctggctaacatggtgaaacccccgtctctactaaaaatacaaaaaattagccaggcgaggtgatgggtgcctgtagtcccagctgctcgggaggctgaggcaggagaatggcgtgaacctgggaggcggaacttgcagtcagccaagattgcgccactgcactccagcctgggtgacagagagactatgtctcaaaaaacaaaaaaaaaaaaaaaggagggaaatttggttatttggtttcaaagacacacggggagaacactggtgattacagacacagaatggagtgatgccgctgagagccaaagcatgaccaaggattgacagccatcatcagaagctcggaagaaacaaggaaggattgattctatgcaatctcagagggagcacgaccttgctgacaccttgatttcagacttctgggccccagaactataagagagtacatttctgttgttgaaagccacctgctttgtgacattttgttccagcaactgtaggaaactaccttacctttcatatcttgttcaagaaatcttttgcactatcatacagatatcaccatatattttttctaaaaaaattaaagtttagccttcatggtttgataatgtcattcaactgtaatttaatttgtgtatgaggtgagataggaatctaattttttttttgagatggggtcttgctctgttgcccaggctggaatgcagtggcgcaatcttggctcactgcaacctccacctcccaggtttaagaaattctctgcctcagctccccaatagctgggattacagtcgcatgccaccacacccagctaattttttttgtatttttagtagagacaagatttcaccatcttggccaggctggtcttgaactcctgacatcgtgatccacccaccttgacctcccaaagtgtggggattacaggtgtgagccactgtgcccggcctaattttatattttaccatataaatagccagttgtccaacactgtttactgattagtccctcattttccctgctgattttaatgtctgttctatcatacaccaagctctcatggttctgtttctgtggatattttttacctattgatctagttgttcattcctgctctacgtcatgtttttatttaaaaattatggtaaactctactttacatagaatttatcattttaatcctttttgagtgtacaattcagtggcattaagtacactgacgttgttgtgcaaccatcactactattcatctccagaaagttttcatgatcccaaaatgaaatgctgcacatattaaacagtaacatcccattactccctggtaattaccattctccctaatttgtctataaatttaactcacttaagtatctcatatattatgcaatatttgcacttttgtgactggcttatttcacttactataacgtcttcaaggttcttccatgttgtagcatgtgccagaatttccttcctttttaaggttgaataatattctattttacatgtataacacgttttattcatccactcattggtcaatcataccatctggttttaaccactgttgctttactataaatcttgatatcagggatgtatgctccctttctttagtcctgtggtacaaaataatctgagctattcttagctcttacttttccctgttaatttgggaaccacctagaagttgtgtacatgcagacacacacacatacaaacacacacacacaaccttttagagattttgatagaattgcattgaattgctggattaatctggggatagcttccatgttttagatacttagcttgatacttcccaaacgtgagtgactgtatccccccatttatttagaccatctaaaatgacctccaataaggttgcatttatttacttatttttgacatcgtgaatgggatctatgtcttttaatgacattttaaagtagctgatgcagggagcaggtattaactttgagaaacagtgcaacatagtgattgagagcattgtctctggatccagattgatggaattcaaatcctagttccaccacttacttgaacagattagtaaattctgggtctcagtttccaactctgtaaaacagggtcgttactgtagtcctctcacatgattgatgtgaatattaatagattttacacttaacatacttagcacaatgtctggtacataataaatgcaaacaaaatttttaactattggccaggcatggtggctcatgcttgtcatcccagcactttgggaggccaatgcaggcagatcacttgagcccaggagtttgatactagcctgggcaacatggcaaaaccccgtctctacaaagaatacaaaaattatccaggccttgtggcatgggcctgtgttcccatgactcaggaggctgaggtgggagaatcacttgaacccaggagaccaaggctacagtgagctgtgatcacaccactgcactccaacctgggctacagagagagaccctatctcaaaaaaaaaaaattgttaaccgttattattatattgatctgtacccataaaccttaccaaactctcttattcaaagctttatgaagatacaaagatcttcagtaaaaggaaacacataataaaatataaaaatcagaattattgtaattttatttataaactctgtattttctacaatatctaaaacataactgcataaaacaattacaagtctatgttagtgggtgcatatataaagatctaatttgggacaataatatggagttaggaggaagggatagagctctaaagaagtaaatgttttttatgaaattgaagttaagttggtatcaattcaaaatagattttataactttaggatattatatataatctttatggtaatcacacagaaaatatttatagaatctacatgaaaggaaatgagatggtaataaaaaagtgtcaccataaaaagtcaactaaacacaagggaaggtagtaatggaggaaagggacaaaggaagctatatgacacagaaaacaaataacaaatggcaaaagtcagtccttccctgtccataattactttaaatataaatggatcaaattccccaataaaatgctatagataggtaaaaagactaaacacattaattaaaaaaaccatgatcccactacatgctgtctctcagggactcatgttagacctaggaacacacataggttggaattgaaaagatggaaaaagatattattgcaaatagtaaccaaaaaggaactagagtggtcatactaatctcagacaaaaatagagtttaagtgtaaaacacttacaagagacaagggttcatctagattggatttacaaagaagttgtgaagagatagtctagagagttcctgtatatcctacatgcagtttcccctattgttaatttttttgttagtatgatacattggtcacaattaatgaaacaatactaatacataattattaaggaaagtccatactttatttagatttccttaatttttacctaatttttttctgttctgaaatcctatccaggataccatgttacatttagacttcctttctttttagactcctccagacagtggcagtttctcagatgatcattgttttgaagcctttacaattttgaggagcaagcaggttttctgtagataacactttatcaggttaaagaaattactttctatccctagcttcctaagagtgtcaatatgaataggttgttgaatgctttgtctagatatattgaaataattatatgattttttgatccatttacctgttaataggtgcctgcattaatagattttttatttatttatttatttatttaattaatttatttattattattatactttgagttttagggtacatgtgcacaatgtgcaggttagttacatatgtatacatgtgccatgctggtgcgctgcacccactaacttgtcatctagcattaggtatatctcccaatgctatccctccccctcctcccaccccacaacagtccccagagtgtgatgttccccttcctgtgtctatgtgttctcattgttcaattcccacctatgagtgagaatatgtggtgtttgtttttttgttcttgcgatagtttactgagaatgatgatttccaatttcatccatgtccctacaaaggacatgaactcatcgttttttatggctgcatagtattccgtggtgtatatgtgccacattttcttaatccatttgacacagccatcccattactggctatatacccaaaggactctaaatcatgcttctataaagacacatgcacacgtatgtttattgtggcattattcacaatagcaaagacttggaaccaacccaaatgtccaacaatgatagactggattaatagatttttttataatggtaaattattcttataatcttgagacaaactctaatggatcatgttatttattatatacagtagtgaatttagtttgccaatattttacttaggaattttacttatgtttagtttacttatgtttgttaataagattattttaaaatttttcttcctcattgtattcatatgccattttggtgtcaaggttatactaacttcctaaaataaggcagggagttttcccttttacagaagagtagaattttgataagtggctcagtttatttaatgattacacatatattcatatgattaatttctttttatttcatatttatctaaaaaatattcaaatgtttgaacatttattagcattgatttgtgaataactgatgcatattccacaaaatcattctccagttagcctatcttgatataaagcattttggtttttaattcaaacacttcgtggaacacgggtatctcttactacaacatatttcagatgggtagtttgcaaatattttctgccattatatgggttgtctcttcactttgttggtttttcatttgttgtgcagaagctttttaacttaatatgatcacatttgaccatttttgcttttgttgcctatgctattagggcattacccacgaaatttttgctcagaccaatgtcaaggatacaggatagagtggcagttacccagaggctggaaagagtgtagtggctgtgggggtcagtgggggtagggggttgggaatgaggtgtggatgcttaatggtaaaaaaaaatagttagaaagaatgaataagacctaatatttgatagcacagcagggtgactatagtcaataataatttaattgtatattttaaactaactaaaagatgatagttggattatttgtaacaaaaaggatgaatgcttgcggtgatgaatgcccaattttccttgatatagttattagactattgcatgcctgtaccaaaatatctcatgtaccccataaatgtatgcataaatgtatacacctaccgtgtatccacaaaaaataaaaaaatagaacaggcccagaggcttacacctgtaatcccagcactttgggagacagaggcagcaaaacaccatctctacaaaaaatacaaaaattagctaggcatggtggcacacacctgtagtcccagctacttgggagaccaaaatgggaggatcacttgagcccaggaagtggaggttgcagtgaaccaagatctcgccactgcactccagcctgggtgacagagtgagaccttgtctcaaaaaataaataaataaaaagtaaaagaagaaaaacaagaaaaaatcatttttcaaacaaagtttagaagtgaaaaagttaatttgcctctacaaaactcagttcagcagtttaaacaaaacatattctgagaaaattctcaaattacatcccacataccattgaaattcatgttagaactacatgtagacatttcgaacagtgtgaatagagacaatttaggtaatatgcttcttggatgttagtagtactaagtgaggcagcaaagggtcacaaacggaaagaaaccaagctcacaaacaaaactaacttcaaaaggtggtttgtttgtttgtttgtttgtttgtttgtttgtttttgggggacagagtttcaatcttgttgcccaggctggagagcaatggcacagtcttggctcaccgcaacctccgcctactgggttcaagtgattctcctgcctcagcctcccaagtagctgggattacaggcatgtgccatcacgtccagctaattttgtatttttagtagagatggggtttctccatgttggtcaggctggtctcgaactcttgacttcaggcgatccgcccaccttggcctcccaaagtgctgggattaaaggagtgagccactgctcctggccactaacctcaaaagtttttataaatagatgtttgacaccacagtaaatatatccacccttccaaaggaagctctctttgcagaaacagataaaaatatcttggaaggttttgaaatctcagactaaagaactaccaaattttgtctgtgtgcagtggctcacgcctgtaatcccagcactttgggaggctgaggcaggcagatcatgaggtcaggagatcaagaccatcctggctaacacggtgaaaccccatctctactaaaaatacaaaaaattagccaggtgtggtggcacacgcctgtagtcccagctactcaggaggctgagacaggagaattgcttgaacccgggaggccgagcttgcagtgagctgaggtcacaccactgcactccagcctgggagacagaacgagactccgtctcaaaataaataaataaataaataaataacgaactaccaaatttgtgcagctggatgtgcaatgtcaatttgcagaagagattattgattaaaaagaacccaaagagtagctaaccaaaccaccaaatgcagctgacgtcaaagaatttatggcaatgcagatgcaaaaataatgtccttgaccatggtggcaatatgataaaagcctttctttcaaaaatggcccaatgtctttttggaaccatagaaagacgtgtatgaaagtaaacaagaggagcatcagcaaagagcaaagctctatttagcaactttcttcatccaaaagcatcaaacctcattccctgagaaacggatatagcaacatcaacatgatggagaatcttatcagatcctgaaattgaccctccaccacctaactcctctgtgccatcacctgccacaaccaatgacaaaccactacagctttaacccccttccttatgtctcttctcaactttcttctaccttaaatttctacttcatttagtaaatataagccaccttgttttgcttgtacattttgtctacagtttttcaagcgatttattttgcatcttatttgtttagctatattagaagtgtaatttttggtccagtgtacaagatgtacatgctattacatagaaagtcactgttaactatattaattgttttgtgatttgggttttaagttacattttaacttttaaaaagaaaatcttatccattggtgaggggccaagatggctgaataggaaatgctctggtctgcacctaccagcaagaccaatgcagaaggcaggttatttctgcataaattgaggtacccagtttatctcactgggactggttaggcagtgggtacaacctatggagagtgagtagaagcaaggtgtggcgttgcttcacctaggaagtgcatggagctgggggacctccctccttgagccaagagaagcgtgagggactgtgctacccagccaggttactacacttttcccgcggtttttgcaatccacagatcaggagattccctcttgtgccaacaccacaagggccctaggtttcaagcacaaaacggcgtggctgtttgggcagacactaagctagctgcaggagtttcttctttttgtaccccagtggcacctggaaccccagtgagacagaactgttcactcccctggaaagggggctgaagccagggagcccagtggtcttgctcagtgggtcccactcccacagaggccagcaagctaagaaccaccggcttgaaattctcactgccaacacagcaatctgaagttgacctgggaccatcaagcttggagtgggggaaggggcgtctgccattactgaggctttagtaggcggttttcccctgacagtgctaaggaggctgggaggtttggactgagcagaattcaccacagggcagcaaagaggctgtggccagactgtttctctagattcctcttaacgggggagggcatctctgaaggaaaggcagcagccccagtaaggagcttacagaaaaaatgtccatctccttgggacacagcacctggaggaaaggactgctgtgggcacagcttcagcaaatttaatctttcctgcctgccggcactgaagagagcagctgatcctgacaaggaggattctcccagcacagtgcaccagctctcctaagggacaaactgcctcctcaagtgggtccctgacccccatgccccctgactgggagagacttcccaacaggggttgacacatacctcatacaggacagctctggctggcatcaggccagtgcccccctgggatgaagattccagaggaaggagcaggcagcaatctttgctgttctgcagcctccactggtgataccaggtgtaacagggtctggagtagacccccagcaaactgcagcagacctgaagaaaaaggttcctggctattagaagaaaaactaacaaacagaaagcaacaacatcaacatcaacaaaaaagacacccacacaaaaaacccacccaaagattatcatcctcaaaaatcaaaggtagataaatccatgaagatgaggaaaaaccagtgcaaaaatgctgaaaattccaaaaaccaggatgcctcttctccaaatgatcacaactcctgtccagcatgggcacaagactggaaggagaatgagattgatgaattgacagaaataggcttcagaaggtgggtaaaaacaaacttgtctgagctaaaggagcatgttctaacccaatgcaaggaagctaagagccttaataaaaggttacaggaactgctaacaagaataagcagtttagagaagaacataaatgacctgatggagctgaaaaacacagcatgagaacttcgtgaagcatacacaagtatcaatagctgaatggatcaagcagaagagaggatatcagagactgaagactgctttactgaaataagctatgaaggcaaggttagagaaaaaaagaatgaaaaggaacaaacaaagcctccaagaaatatgggactacgtgagaataccaaacgtatgatttgattggtttacctgaaagtgac

SEQ ID NO: 17 - DNA, 605 bp, Homo sapiens
cttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaag

SEQ ID NO: 18 - protein, 52 aa, Homo sapiens
MAMMEVQGGPSLGQTCVLIVIFTVLLQSLCVAVTYVYFTNELKQKSNKIFLP

SEQ ID NO: 19 - DNA, 652 bp, Homo sapiens
ctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgacc

SEQ ID NO: 20 - protein, 98 aa, Homo sapiens
MAMMEVQGGPSLGQTCVLIVIFTVLLQSLCVAVTYVYFTNELKQMQDKYSKSGIACFLKEDDSYWDPNDEESMNSPCWQVKWQLRQLVRKKSNKIFLP

SEQ ID NO: 21 - DNA, 1914 bp, Homo sapiens
atttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaattt

SEQ ID NO: 22 - protein, 279 aa, Homo sapiens
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGSIYQGGIFELKENDRIFVSVTNEHLIDMDHEASFFGAFLVG

SEQ ID NO: 23 - DNA, 44728 bp, Mus musculus
caatcccttatttttagccaagaatatccctaaaataattttttttttttggcagacaggttaccatgtgagccaggccgactttgaacttattttatagacaattatgactttgaacgatttatcctcttgcctctacctcctgagcacacactctagcacacatctgcatgcctggctgcatacactagactctaaaaacatgcatctgtatgtatgtgtctagagaacactggacgagtactcccgagtcagggcttgcttgcatctacagaagcagaccgagaaccaaaactgaggaaggagacagagaagaccaaccaagggaacgagcagcaggcatggcggcacacacccataatcccagcataaaggagctgcaggtagaatgatcaggagctccaggtactgactggcactgactatatcgtgagttcaaggccagcctgggctacagaagagcctacctaactcaaagaaaggaaaaataaaaagagagagagaaaaaaaaggaggaataaagatattgagtcttatctataaattttaatttttttcttcactcaaaaatcttaaaacataatttacagctttattgtatcatgaactctatttcacacacacacacacacacacacacacacacacacacacacacactgaacacccatagtgagatcagatgttctgagaatcttcggctccctaaccagtctttcctctctgaccaggcagagtcagccctggcctgtccattatccctcattgttcttccctcactagccttacctgaggtgtgcactcgacaatagatgcttggggagttcacccctctgaaatacaccccaccaactgttcagtggcctgttgctgctgctgcttctcttccttccttccttccttccttccttccttccttccttccttccttccttcttctttctcctcctcctccttcttctccttctagttttcaagaatattttttaaggactggagagacagctcagcagttcagagcacttgttgctcttgcagaagaccagggtttgattcttaggacccacatggcagctcccatccatccacaactccagttccaggagattgacactctcttctgacattcaaacacgcagggcacacgtggtgcacagacatagatgcaagcgaagcattcatacaaataaaataaacagtcgagcagcacttgggaggcagaggcaggcagacttctaagttcgaggccagcctggtctacagagtgagttccaggacagccagggatatgcagagaaaccctgtctcaaaaaaccaaaaaccaaaaaaaaaaaaagccagcccctgtaggctcaaatatttaagaattagaaggtttagaaggtgggccttgtttgagtggggttggtcttattggaggaagtttgtcactaggagtgagctttaaagtttcaaattgtaaacgaacccccaattaaatccatatatatatacatatacatatgcatatgcatacacacacgcatacatacatacatacatacatacatacatggatatgctggggcacacacgtgaaggagtgttttcctgaagtagacatacgtgaaagactaaggcagacctgtgaagctagaacttgtgtaactagaactcgatgggcagtgacaggctgagctaggcttgctggcacagctagctgtgcaatgcctgtgggtctcgagtctttgctcatcttcaatttcctgagagaggcacagccaagaacttctcctggtgttcctcctggtccctcctgctaactggtaccaaggctgaggcctggctgtctctgccaccactgttgactcgtgtttgctatcctgactctaatgaattggactgctggtgtatccgtgaagtgtttgcaagtaggtcaagctatggctgcctgctgatctgtgaactgaactgctgatttccagacagcacagatgggagttgctccaaagaacctttctagacaggtccacctcccccttatcctttctttcctactacctctggtgggtggtgggctaaaaggtagttaaagcatttaagaaccatcactgaaaataggttttgaaaaacttaatttacacacacatacacatctatccttggccatagaaatagcaatagaccagtaactaagacaccatgtatagaagaagacagtacttcacaccctcctctctccccgtcctccagctcttacacttcctgcccctcccccataatgctccctgagcctctgtgggaagggtgatgtagctgtctcatttagagctgaactctcaactgtcactcattctctacactctgacctcttaccagtctctgtaataactgctgcccactgcaggctgagaacagcagtaattcatgggtgtaattatagttagcagtttaacagcatgtagtagtctatgatctcccaagccatgggcttttgatcttttatattttagtttagtttaattatttgtgtgagtgtgtgtatgtgtgcacacgcacatgcgtgcgcataggtgtgcatgtgatctgtgtgagtgcaggcacacaagagcacaacttttagaagtggcttctcttccaccatggattctagaaattgaactcaggtctttaggcttgttctacaagcacctttaccagctaagccgtctcactagtcctggcttgttcttccactacatctctcttaattttatagttttccatatgtttactacttgatttgtattgtggttttcctaatggcatatggggacccaagtttagagctccctgactgtccagacatcccaggaagcagacagttagcaacagacagtacagtaagacagacgacagagtgcacctagcaaaggaagcaggaaagaggcagcagaccctcagggaccaccagaacggatggacagacatcaacagcagagacagactcttacacctcattgtaaactttcagcaactttggggctgggtcaggttctcccttctttatcatagttgactaccccttccacaactggttctagttttcaccatattttcatgtccacattcaacctatcagggcacccttaaatctaagcagagtgcatgtttgaatatgcttggcccatggaaaatgctattaggatgtgtggccttggccttgttggaggaagtgcatcactgtgggggtgaactttgatgttctatgcccaagcttcctccaatagagaagagagcctcctcctagttgactgcagaagtgaggagtcagtcttctggctgccttaggatcaagatgtagaactctcagcatttccagcaccgtgcctgcctggatgctgccatgcttcctgccatgatgataatagactgaaccttggaaactgttagccaaccccaatcaaatgtcggtctttataataggcttgccttgatcatgatgtctcttcatggaaaccccaactaagacagtgcattagaatttgaaggaggagaaagcccttagcttgcccagctatcctaccggcctgaactccccctctatactcccaagggctggacaagaatccagtcataactaactgccccgatatatgatgtgggaggcagaggtaagtggttctctgggagtttaaagccagacctggtctgtttagtgccattcagggctacatggtgagacctggtctaaagttttaaaattaataaatataaatgaatatatgtacagctatacacttagaaatggtaaatatggttagcattatgcatattttaaacacagccagtggttcagataccttaaataagggacaacccctctttccagttctgctaattgaggatccttatctgctcaggccaggaagacaagagcttcccatgggcactttcagccaggagaggcctggcatacagatagaagagaacaccgtctctctatgatcaaatgaagaagggtgacacttctcacccttgccagtgggggataggagcagggggccagtgtttaacagctggctccacctgcccatcataatttacgtgtagcatctgctgattttcactgtccatcacagcatccccccatggccagtttgccggtttgatgcacagcacagcacatcactgtaacattcctgaaaacggaacaatctggctttggctgcagagagcggttctttgcagtttacccctgcttcggatgacactcacaggcagagtgggaaatggaggcatgaggtagctggtaggacctgcagtactttagtctcagagctgaggggcaaggcagggactagacctgctgtgtgttgcctactttcacctgttagcaagaggaatcactcagacacaggtgtaagtaggagctctgtgaatgaggcagccctaccccttcttcagatccctctctgcattgtgaggaatgaagagagcgcacacagggcccgaatgctgcgcatgtgaagcatgttcaacgcagtgagccacctctgctgcctccatccaccgatgcaatgcatcggtccagcgcccaggtaaactgctgccccttcatctccactccttgcgacttgcagactcaagtaccagtgaaggggaaaaggcacaagtatcctctgagcacctcaacaaagtattttagttagggttttactgctgtgaaaagtcaccatgaccccagcaactcgtttttggttggttggttggtttggttggttggttggttggtttggttggttggttggttggtttggttggttggttggttggttggtttggttggttggttggctggttggtttggttggttggttggttggttggtttggttggttggttgtttggtcggttggttggttggttagtttggttggttggttagtttggttggttggtttggttggttgtttggttggttggtttggttggttgatttggttggttggttggttggtttggttggttggttggttggtttggttggttgattggttggttggtttggttggttggttggttggttggttgtttattgctttcccagacaatggtcccctccctggcatctttgaggatttgctttactaggctgatcttcccagaccaaaaccctcaggacgcagcattaaagcggcacacaccaattcacgtgacatctgctttcctaaatcagcctcacttcctgtcaggattgcctccctacaccgtgggcacatgcaaccctgagtgttagcaggccctacgacaaaaacagagagagaaaggaaaccacaaaggaggcacccggaacctgtgacctcagctcccacaacaaacacctgaaacactgcaccacgctttcacattagggttcagctcaccagaaagaaatgggcaaaagggtggacatgtggctcacttagtagattgttctctcaaatagactcagtgctaagggcggggggggggttatttttgggtttttttgagacaggatttctctgtgtagccctggctgttctctctgtagaccaggctggtgtcaaagtcagagatctgcctgcctctgccttccaaatgctgggattaaaggtgtgagccacctctgcctgactgatgttaggtttaacatttagcactgcataaactaggtgtggtggtgcatggctctcatccttatcatacatatatacatacacacacatacacacacatatatatatgacatatatattatgtatatatcatatatatgataaagatgagggacatatatatatatgtatgtatatgaatgataagaatgtatatgtgtgtgtgtgtgtatcactaacatcagaaaggaatgtcaagtaccatggctggggacagcactgaatccagaggcagctgccaaggcgctgtcagcaagcactgtccagagcttcgcttacccagagtctgagaaagaaaaccgttagagctaccagacaggacactggacaataaatcctcctaaataaagtagaagccttaagggaatctaaacaaagagccggaacctactcaacaattcagaagctcagccatttgtctgctccaaaaaatgtcttcccagagggcctcaaaacagcacctgctgtagccttgctcctgctgtcaccacagtcagatgtgaagaccctattgctgaaaacgtaacacagtgtgggcagtgtggtcgctagagagatagttctgggttatatagaaagcaggttgagcaagccagtaagtgctgtccccctgtgatctctgcttcagttcctgcctccaggttctgtaagtcagaagtctaaaggaggcctcagccagggatgcagctcacggcctggcctcagcccccaactcattgccctcatcttccttccgtcttgcaaatcagcaatgagtcctcatatgactgcttgtttgttcttctgcttccacttgagaccacttaatatgcccagcagagctgtgcacctctttaatcccaagcattcaggtggcagaggcaggtggatctcagagtttgagaccagcatggtctacagatgtaaacaacaccgagagacagggtcctcctggctggcacaggcttcggccttttctttctcccagcatgagattcctggggaaattccagtttcttgggggaccatttttgcagtcatttctgtagccaaaggatatcttcattcctaccagggcaggagaataaaaacattcaaacacataaaataaacaaaccctttgaaattattttaaaatattttcaaaaacatatttctaataagagattagtatctgaaacagtaactaaaatcaagatgattagaacagaagcaaaagacctaataaacatttcttcagagaagaggtacaattctcgataagcatgtgaaaggctaaggagaggagaattgggatctcacggtttagcaggtatggagtttggggttatattgcttgttcatgtatgagggggagggcgttggtctcactgcttctggccaggatggtctcctggacttaaatgacccctcccactcaagctcccgaggaccaagaacctcagacaggcacatgtcatcatgtccagcttaagagttccaattttatagtataaagagaatatacagatgaaaggtgatgcgttggctgtcatggttacagcgaaactacttcagaagacaacttggaaggagaaaggagttgacttcggttcacagtgtcagagatgtcaacctctgactgactagtgccattgcttctgggcctgtggtgaagcagaactttatggtgaaaagggtgtggcagagtcctctcacttcacagcatctagaaagcagagacaccgagggagacggagagaggaaggaaggccatgaggataagacacaccattcaaaggcttgattctagtgagccactaattctaacttggccccactgcctatttagccatgtagtcatcaagggagtacttcgtggatgaagcctgcttacctccccatggcactgctgctccagccatgagccctctgcggtacacttcatatctaccttgttagggtttccattgctgtgaagagacaccatggccagggcaactcttataaaggaaagcatttcattggggctggcttacagtttcagaggtttagtccattatcatcatggcaggaagcatggcagtgtgaagaaggcacggtgcgggaggagatgagagatctacatcttgatcctaaggcagccaggagactttcatccacactgggtagagcctgagcattggaggaaaccttaaagccacaactatacacttcttccagcaaagccatactctaaccaggccacacctcctaaaaatgccactccctgggccaagcattcaagcacatgagtctatggggcccaaatctattcaaaccaccacattaggcaaacctaacaccagtgttacttcaggagagccaggcaggccctgtccctgtcctgagcctgtggaggaagatagactttgaacctagaggtggaggctttagatgaggacacaactcatggtctggccaagatgttaagttctctgtgcactcaaagcctctttttagcaactttctttctacagttcttcaacgccaggtcctattcattcctacagggtcagccgtcagctccccgcacccatgacatctgtcttcagatttatgactaacggtgaagatgttggagcctgggaatgaggaaggaaattccttccgttgtaaagttgtcgcggcctctgctgggcatgtggtggagggtggtttcctttaaacagaacatgctgcagctcctggctcgagtggacccttgaagagctgtagtgggggctggggaaagggaggagggtggaaaaaatgaagagacaggaagctgaagcatgagatagaaagaacagatctaacatcccccaggtgcgaccacagggctgtgacatttcaccaacactatggaaacaactgtgaagcccccaaatgagacatatccttgagataagtcagcaggggaaagagtggagggggttcaatggcccgtgcttctccagtgtagcaactccagcatcctcaaatcagaattcccagaggagcatgaggcttaagatgatggcccacgtaggtgcccaccttcaatcccatgtgcccagggccatgaagagagatggctcaggtacctgaagatactagtgaccaagccagccagaagcaggaaggataaaaatgggattaggtcaagaaggaagtttggcaaaagttcccccaggcagtgggtcacatctgtgtcacaggctggcattaagaaggaataaaaccaggctggagtggtagctcagtcaggaaagtacaagggcctgagtctgatcgccaaaacccagtttttgagttcatttctttgtttgtttgttttgctaaaggatcccagggtttgatggtcatccagcctcctctactaggcaagttgcaggccagtgagaaataataatctccatcttctttatcatcaccaccaccatcatcatcatcatcgatgtccctgaggaatgaaaccaaggttgtcccctgacctccatgcgcatgaacacctacacacacacacacacacacacacacacacacacacacatgtgcacacaaggattaaagggacttgatatcacagaacagaaaaagacacagggaacacagggctaactcttgccctcaattgtatgcaatgttcaagagcttgtatagccagaaactcaaacctcagttatataaggctggttgtcatgactcctcccctttatacatgcaatagctttgctgcgtgtgctgtgtccaagctgggaatatagctcagacagcagtgtttgcctaggatgcaaaaagccctgggtttcatccccagtaccacataaacgggatgcggcagcacagcgctatggcaccagcagcagtggcttggtagcaaaccctgcaacaccaggaacactcaggagagggaggcagaaagatcagaagtcccaagtcatcctcagctaccaagcaaccttgaggctaccttggcatatataagaccgtcttccaaactgttgtgcttagccgtgtcaccccacctctaatggggtgttttgtggtactagttttaggcaaaatctgaaaatgtcatgattttaaaactaacctgcccctaggagcttcagaaataatctgtaatctgctcctatctggtcacctctggaagggctgggctatgagagaggacacttgccagggacagatgagggcacccagcgtccatccctatcaacaggtccggcggctgtgggtattcattactgagagaggtgcccaaggggggcacatgtctgtgaagctcagcagagctgggtttaccccttcatagtctctccggagtgcggaaaagagaagggggtggaggctgctgagagagagacaaagaaaaccaaaacagccacaactgccttcaaaggtcggtttaccacccaagtggagtcgcagtggctgctgcccagagcacataggagccaccagtgactcggtacaagcagttggggctcagaaaagatctccctgggcaggagctatggcatggccacctccctactggctctgcatgctggggaccttggtaggactctcagctaccctagccccaaacagctgtccagacaaacactactggactgggggaggactctgctgccggatgtgtgagccaggtaagagtgggcctcagcagggttggggggagactgatatttaagatgacggaggtactcagaataaggctgagctcaagcaaagtcaggcagcctgcagagcctagagccagcgccttgcctggacttccacctggcccctctgctctcaggtacattctttgtgaaggactgtgaacaagacagaacagctgctcagtgtgatccctgtataccaggcacctccttctctccagactaccacacccggccccactgcgagagctgcaggcattgtaactctggtgagaggggcagtggtgcggaaggcagcactgagaaaagagtccgggggcaaggccagaggggctggctgtggagtcagagagcttcagctgcttcaaggcccatggaaagtggagcccatgctgaaacccggtgtgccttgggcgaggcatgtggggagaggtctagtgtttcatgggagatatgcagaattcgagggatggctaaaaagggctccatggataggactcagacaacagaagaatgagggcccgtgcagtcacgcacgtccataatcccaactacaaggcaggctgaggcaggaggatcactggatgataggagttcaaggccaggatgaacaacatagcaagaccctgtctcacaaaaaaaaaaaaaaaaaaaaaaaaagccaaggagatggcacagtaagtggcaacagtacttttgccaccaccacgcctgagtttactctctgggccacatggtagaaggaaagaatcaactggcaagttgtcctcagatcgtcctatgtgtccatgagtacacacgaaaaatgaaaaatatataactcagagtgcaggggaggggcaaggtagttccagaaacccagtttccagaaaagcaacgtccagccaatgagcagtctatgttcccacagtgtacatgtgtaggtcagctcttatttggagttggggaataacaccagaaaccagggcatagcaacctttttgtacaaaagccttttgggaggaaagcaagtagatctatcatttctcttaatttatacatttctactttttgcaaaggaagaggtaggatatctgcagtctcttttcaaactcccctgttgcctccccacctatgccagggatttgggaggcctgtgttaccgtacactagaatagcataatttaaagaggcccctttaacagtgagcaggcactttgtgtgtaggggaaaaaaaaaaactctttaattgctgttgcaaaaaaaccccatatatatatacacatacatacacacacatatatacacacacacacacatatatatatatatatatatatatacacacacacacatacataactgattttaataacattaatagagaatatgttctggaatgtggaggcaattggctggtaagttctagtaacagaaccatccaaatggttagtctgagacaaacacctaacaagaaaagtcttcttttgtgggactttcagataagtcctacagaaatattacactgtgcctaaaccaaacttgaattattttccaagtgttaaaagtttcatataagtaagggcaggtgtggtggtgcacaactttaatccccacattcaggaggcagaggcaaacaggtttctgagttcaaggccaacctggtctacagagtgagttcagggacagccaggactgttgttacccagagaaaacctgtcttgagaggtgggtagtatatgattgccaataattaaaagctttaaagtagtagtgagtaggaaagaaaatcatataatctttttctactttcagtttctgtgtctgagcctgggaaaggtagcaggcagagaggggcaggtgacagcaggggaggggcaggtgacagcaggggaggggcaggtgggggtgagggaggggcagaggggaaataggtaaggcgcggggagtggaagaaattcataccctgtgagtgagtctcgggggtctcaggagagtcaggggcaagtagacaccccaggtctctaaagatctgtggtgtcctgtttctcctggctctcctctctcccaaggttttcttatccgcaactgcacagtcactgccaatgctgagtgcagctgttccaagaactggcagtgcagggaccaggaatgtacagagtgtgaccctcctctaaaccctgcactgaccagacagccatctgagaccccgagcccacagccaccacccacccacttacctcatggcacaggtatgcagcaggctgctccttacccagtcgggacaaggcagaaggctgcctacccagcactgcccagtctgtgtttacccctagctaggttctgggccagcatgtcttcctcctgtctgactcctgcaaaatcacaggaaagcctgggacatcctgggaggtttcctgcttgtgactcgctctgtctgtttcttccagagaagccatcctggcccctacacaggcagcttcccaactcgactgtctatagccagcggtcatgtgagttgtcttcctaatccccactccacagagaaagcacagaggaaagaggccaaaagaacagccatgggaaacccctaggtgctgggtgagggagaggggtacagagttggggagaaagttcggtggataacttgctatacaagggtgacataatacccagggccacagggaaaaccaagcagagtatggaagctcgtatctgtagccctcacattcagaggcagaggcagagccagcagagctcaaaccagcaagcttccaggtcagggaggaatcctgtctcaagggactaaactagactccgagaaagacacagagacagacagagctggaggcaaaggagggggaagcagactctagttagagattaggagagaaaggactggtccaacaggggcagggttactcaggaaaaggacagacagacagggctaagggtccagggtgagatgcccctccaaagcctcggtgtgctcttgcccgtcacagcccatagacccctgtgcagctcggactgcatccggatctttgtgaccttctccagcatgtttcttatcttcgtcctgggtgcaatcttgttcttccatcaaagaagaaaccacgggccaagtaagacacaggccttccctcctgtctctcagctgtgctacccacacctaaagcccccacacctactccacccacctactctggctcctcaagtgtccttcccccagactccccaagccccccagctctcagccctccacttgggcttttctcctcttttctccccttcacctttcttctctccactgctgaccgattgtgtttgcacagatgaagaccggcaggcagtgcctgaagagccttgtccttacagctgccccagggaagaggagggcagtgctatccctatccaggaggactaccggaaacccgagcctgctttctacccttgaccgggtgctggtggggccctttctgacgaggggccatccacagagacctcaatggtggcctgctcccctgtcatggtcatcagaaccctttcctgtgaatactcaacaaactgcccttctgagaccaacagggacaagagcaggatcccagtgtgtggcccagcaagctggggagactcaggctctagctataaagcacacttactctaagtgaaaccgtccagctgacaaaactacatgccaggggtggaaatggctcaccaagggctccagagggggcttggcagtgaggagcacgaagtgttcctccagaggaccagagtttgattcccagcactgtcaaatggatcgaaaccagctgtaactctactttcagagggtctgacacctttgacctcctctggcatctacaaacacaggacacacacacacacgattaaaaataataattttttttaaaaaaatggaatgagccaccggcaggtgccctggtaccagaaggactgactgccgtgagagacactatctacagacacacagacttcctggccttggttctgtcttctctgtaagttgtgacagtgctgtgggaaagctgaggctgagactttctctcagttgagctaaaactataaataaattcatttgtctacttctatacacattgtcccttctctctgtgcaggcaaacactggaacccggagccaagccttacggcccagggactctagtaacaagccagctatggacactctccatgtgctattccccttcctacagaatgagggtaggggaacaagaggaggaggaggaagaagaaaaaaaagaagggacagtgaactaggaagaaggatagtgtaaatgctaacttcaaatacgcacacctacaactgaaacaaacaaacaatccctcagtgtggccctgagcttgtaattcaaggggttaagtggtgtgacaagggcggggcttggagtagagacagcaggagatcactgctgtgcttgttggctaccaaacaattccaggttcagaaagagaccctgtctctgaagaataaggtagggtaatagagcaagacacccagtgccctcaccgagcctccacacacaggcagggctgggcatactcacccacacaagtgtatacaccgcatatacacaaatacaagttaaaagtgagacttcacatagctgtccagcctcctaaaattccaatcctagaactaggccacaccccatctcgtctgttcgatcacagatctgaacagggagttgtcaccagggcagacccaaaggatttaacatggactgaaaggaagaagggtccagagtaccggggaatctatcttctggctccaccccctctccagccctctcatagttggggctgatgggaaagctgatgtggtgataccaggttttgaaatcacctggggatttcttgggtgcggggtggaccttagggagaacagaaagcagagctggctgcagccattactggcctcgggcgggcggccacagaggcagttgaagtgaaagtgaaagagaaacgataagagaacggagaccacaggtgctaagtgagggtgctcacagaaccccctcttcagccagagatcactagcaggggaactgtggagaaggcagccagcaaggaagagcctgagagtagcctccatgggcttggagcccagctggtatctgctgctctgtttggctgtctctggggcagcagggactggtgagtgcggagaccaggctggggcctgggggactgggggggaggaagcgccaagctaaaggagccccaggaagccaccttctcagaacagcaccagcttgtctgctaagcccagcaaatgagtgcggcactcacaacatgcggaaccagtttggagaggggtacggcagagaactcacagaaaaggggggcttcctcgatgggaaggcagggtgttagcattctgtgggacagctcactgccctgagttgaatccttagaagaggaaggggctccccaggctaagaaatcattgggttggtgactcctggtgggcgtggctatggcagaaagcagaggcctctgggaaagttgggtgatgagaaaaaggttgtcaatgtccctaggaacagcaagtgtcttggctcctctcccctgtggcagtatttcttattcctttttttttttttttttaacctgagaattcctttccagaaattcccttgcatcccacagctgagactcagaaatacaaagcataaacccctctggctttgatcaggacagatctaggacttgaaataactcacagagccgctgcctgagtagcaggtgcctcagcagaagctgggtttatagatgacaccaggacagcggggcccagaaggcacctttacctgctgctcagcccggggcttggtgaaggggtgggaagagtgtggaggacgagggtgcttgttccactttccctgcagaccctcccacagcgcccaccacagcagaaagacagcggcagcccacggacatcatcttagactgcttcttggtgacagaagacaggcaccgcggggcttttgccagcagtggggacagggagagggccttgcttgtgctgaagcaggtaccagtgctggatgatggctccctggaaggcatcacagatttccaggggagcactgagaccaaacaggattcacctgttatctttgaggcctcaggtaaaatctccccatcctaggcttcctccacaggaacagccccgttcccagttctatctacccacgcctgccccccccccccggtctggcgttgtccatccaacattacttctgtatgctgcccttctccccagtggacttggtacagattccccaggcagaggcgttgctccatgctgactgcagcgggaaggcagtgacctgcgagatctccaagtatttcctccaggccagacaagaggccacttttgagaaagcacattggttcatcagcaacatgcaggtttctagaggtggccccagtgtctccatggtgatgaagactctaagagatgctgaagttggagctgtccggcaccctacactgaacctacctctgagtgcccagggcacagtgaagactcaaggtgagaaaacaaaatgcagtggcacaggaacattttgtattattgtgtgtgtgtgtgtgtgtgtgcgcgtccatgcgcacatacgtgtgcacatgccacagcacataggtagagatcagaggacagcttatagaacctaccatgtggtttccagggattgaactagttcactatgcttggcagcaagcactttatgcactatgccatctcaatagccccaagatagttttttggttttttggttttggtttttttttttttttggggggggggttgttgtttttttaatttgttttttgtttgtttggttggtttgttggttggtattttgttttcttttgtggttagagatgggatagaaggaagaaaacaaatatcccacaggtcctcctgaggtacccatagagcttcatcttttctttctaaaatatcctgagtcaagaagaggggatgctaggagatccttattcgagcaagcatcaaaacataataatcatcaggtattttctccaaagtggggaagcaacacatgaggacactgtagctacacatgtcactacactcttatttagccaaactcatgtttcctcccagggagagggagtctggtctggtgcttcatggcaattacagcagagcacagggagaaagaagtgctcagtagctcttactagtgagcccattcctcattctctcccacttagtacctcctaccaggttcaaaaccaagaggaaacatattgacaggcacctggagagtccagttcattattttgcctccaaaaaggagaaaatcaagtccacagaagatgacgatgagggggcccctctcctatccctgcaaacccctaaaacattagcctttagtattatgttgtcccatactgaggatagaacctagagccttgtgctaaacacgagctctactactaaactacagcttcaattcctttttcagttttattgtgaaacaggggtctcacccagatgccctggcaggcctggaaacttgtgattctgtcatgcctccttagtagctgatggtacaggcatatactaccacaccctccggctctacagtcctttctgaatgtgccttgccacatcagaaaagatgttcagcatctcctatccttggccatgggtagtttagtgcttctccctttttgaacttattcagatctacaaataaatgaaacaacatacccccacccagccgtgacttatttctgacctatttcgtcagctgtcatagttcctctctacccgactaacatagatatcctcccctggactgactaggctgtagggaccacaacacttcacccccaaatgctcccatgtgcagttagggctgatagctgaaagtcaaggccactctgcttcacaataaccaaggatcccaaaagcctatcaaggctggggagtgctctactcacagtaacaagggtccagtgcacacaggacttaacagtatttcattcatggaaagacgtgactattgaagctggacgtactgtccacatctgcagtccttgcacttggagggactgaaccacgaagattgtgggtttaggctctcatgtgtgccttgctgcaccattaatttatggctccactggacaggaaatgaactcagtaccactgtccagggaagggagccggagctgtctgtccatggctcagaggccaggtgaccttaaggaagaaacagtctgtaagtcaccctttctttctctctacagtggagttccaggtgacatcagagacccaaaccctgaaccacctgctggggtcctctgtctccctgcactgcagtttctccatggcaccaggcctggacctcactggcgtggagtggcggctgcagcataaaggcagcggccagctggtgtacagctggaagacagggcaggggcaggccaagcgcaagggcgctacactggagcctgaggagctactcagggctggaaacgcctctctcaccttacccaacctcactctaaaggatgaggggaactacatctgccagatctccacctctctgtatcaagctcaacagatcatgccacttaacatcctgggtaaggacaggccttgggttttctgggataagggagagggagatgcctatgggaatgtttcccagactagaatccaaccccagagaaaatttcctcagagaaggaatgcattcccacaacccaaacaccatcttcattctggaggtgtgggtgatcagataaggcgtctcactgaatgccaagataatacccccaggaaataactacatcagaataaaaaccctgggctagctgtctgtaatttcagtcccctggaccatttccttgagagggaccctgcaggtgtccaggcaaggaagtcaatcacagggagaaagaaaccttggttcagattaacttcttcaacctggatccgacttgggaagtctgatacaaggcgatttatccccaacaaacttaaacgcagtataactgggggaaaagttatgctggtataatacagtcccttgtaattacatcaaaactggacttagagtccatgtcatttctttcaagaaaatgggttctaaagataggaagcctgtattagctttagggctttagggaaggctctgagatgttctcagtcatacagatagtgtagaggtcatttgggctatcagccacctctggtcctggttttgggagcttgggggagccccctggttatacagataatataagggtcatttagatcaccagccacctctggtcctggttggaggagcttggtatggcctggaccaacagataacacagatccaggctattaatcacttccaattttcagctttgtggatggaagaacaggtttttgggggtttttgtttctttgattgattttagaacaggttttttaaaaacatctttcccactgtaaagacagtcctgcgtgcttcattcctagttgctctggagacctgcggccacaagggccttcatcttatgttcctagcacttcctaatggcggcaacagccaattaaggacaggcagaaagcagttctcaactcaatgagcaatcactggcttgcagaggtgataaaagagaaaaccaaacggtagggtatgtggctcagtggtatagcacttgctagtacttataaggccctaggttgaattcccagccttttaagatctgtgtccaggaagagccctcaccccaacatcttgaaacactgaggagtttccgtctctataacataccttcacgcttaaagaggctgcaggctcctctgagggctctggtcggatacctctaaaatcttactccttgttctttctccagctccccccaaagtacaactgcacttggcaaacaaggatcctctgccttccctcgtctgcagcattgccggctactatcctctggatgtgggagtgacgtggattcgagaggagctgggtggaattccagcccaagtctctggtgcctccttctccagcctcaggcagagcacgatgggaacctacagcatttcttccacggtgatggctgacccaggccccacaggtgccacttacacctgccaagtcgcccacgtctccctggaggagccccttacaaccagcatgagggttttgccaaatccaggtactgggggtgtcctctctcctcccctgtctgtattcaggctgggactcccctgcttacaggtcatctttggctgtgtgctattctcatgcgtttcctcagttccaccttctgcacactctttatcttatctttatctttcccagagtggcatcctctaccactatgaatccccagcctccaaataatgagatgagtaagcttgggctgggtatcagaggtaaaggagtgctgctccttcccataggagctagagagacaaattgaggcagacagggaaaaagacccaaaacagacctttgagcccagcccaagttcagcaggaagcccttaagactggaagcacagtccatatgaaaaccaaacgacacaagagtctacagaaaacctaggggcctgagggtgtgtgcaaaaaagggcacgaggcaatgatacttaagacgattacatctgcacacccatatgaccaagcattggaaagtcagcttctacactaactttaatattttatgtgtttgcgtggtttgcctgctgtagtgcaccatgggcaagcaatgcccatggagacctgaagagggcatcagatcccctagcactggaggtacagatgcttgtcagccactatgtggctgctaagactggaacccaggtcctttgcaagagcaacaagaactcttgacttcttagccaactctccacccccaatatactcaagagcttctgagtgatctcacatattacacctcccatttatttttggaaaccggtcttcctgagcaggctggcctcaaactcctctgccaagcagccctcctactcagcctcccaaatagctgggactacagacaccatcgccatgtccagaattcatcttacagatgagtaagctggcatttgcagacactgagcagtttgccccaggttctctaccaatatacaataaaggagacactataaccaaaaggcaagctgcaagcccttacgtgtttacaccctatatctacacacacttcatcccaaaggccacagaatgctgcagtttcaggcaggaaaggatgtgcacctcacaatgaaatatccaagagctccagacctatttggttgctcgctagactatgagcttccccaaagcttgccttttgttttggctcacatcattcctcagctatttgctggtagtcactgagatagcctcattctcttctgtaaaacattttcaaatgtcctgagatagaatagggtctagtggggtgtgcctataaacacagcactagaaggctgtggcaggactcctaagttcaaagccagcttggacatcatgaggccctgtctcagaataacaaagccccgatggagtaagaggcagaacagcaacacacaaacttgagagtcttgaacaagtgcagtgctgctgcgtgggcaggctcccgtccttccgtgaggattcacagcacccaggccagagctcccctcctaaggggaggggtactggagggtgagggctcagcatgtggtcttgtgttcattctcacccacagagcagagaggaaccttgggagtcatctttgccagcatcatcttcctttctgcgctgttgttgtttctgggacttcacagacagcaaggtgagtttgtagatcaacctactctcaggtatctgcccacccaaaccagggatgaagtccagtgtgctgagttccagatgtttctaccatacccccaacatctgcttttggaattatccctattgaaaacaatcttgttccgtttttctctcagcttcttcgtcaaggtccaccaggcctatgaggcattctgggtagccgcctgcctgcctccgaatacaaagtaaagtactccacatcctggctacttaaaggaccccgtgtgaggtgtggggctgagctgggcctgaaggtgccagcacattgggagtgcagtactggccctggactgtacaagtctctgctttctgtgctattgagaagagagccctgggctgatgaaaagggacaggacaagaggatggcagaattatcaaagtggaagctaacaccatctatgtgaggtattaagaaattgggggtgggggctggtgagatggctcagtgggtaagagcacccgactgctcttccgaagatctggagttcaaatcccagcaaccacatggtggctcacaaccatctgtaacgagatctgactccctcttctggagtgtctgaagacagctacagtgtacttacatataataaataaataaatctaataaaaaagaaaaaaaaagaaatcgggggtggggggacacacaggggagggttacctaaaaagggctttccttctcaaaggagaaagggaaggaggaatgggggtgggtcttcatgcagaggtactagaaggagagagggaactgatattggaatgtaaaatgagtaaatgaaaaaaaagtcagatgtaaaaaaattctcttagaaaaaggatcaaagtgagggaagcgggagaggctgtgaccactcatgaatgccaacactgtcaaaataaaaacatgctgtgactacagcgcactttcttctctctctccctgttggttccaaaacattcctagctgctccaactcccaactcgttgtttcaaggtacgaagcagaggccctgggctacatctgcaccgttacatcatcagatattagggttctgacccttcagacagctgccaggagttttgggagagttatacaacactccctcagctgcacgagagcttccttgtgctcactgctatgaaataccttatggatacagtgcatccgagcctataaagaccatgaattatgatgtctgttatcaaaagtaaagtggggggctagagagatagcaacccgtggataggagcgctggtagattttctacacaacctggatttggttcccagaaccacatggtagctcacaaccatctgtaactaattccaggagtctaacgccctcttctgtcttcctaaagcaccagacatgcatgtagtactcacacatacatgctagaaaaacaggtatatgcataaaataaaaacaaatgcatctttaaaaatatctgtgcatgagtgtgcctgtgtgtatgtgtaccacacgcacccagatgcctgcagaggtcagacggggccctggatcccctggaactgtagctacctacaggtgttagtggccatgtgggtgctgcaaacgagacctaggtcctctgagagttctctttagtagatctatttatcttaccattttatgtgtgttgagtgttttgtgtgcaagtgtgtatgtacaccacctgtgtgcctggtaccaggagagagtgtcagatccccggggacacacagagggctggggtcggggtgggaggttgtgatcctccatatagctgctataaattggacccaggtcctctgcagaagtaacaagtgctcttcactgctgaaccaactctccagccctaaattaagattttaaaaattaagttgtgaatgatggtgcatgctttaatcccagcactcaggcagcagaggcagggggatctctctgagtttgatgacagcctggtctacagagtacattccaaggcagccagggcaacaaagagaaaccttgtctcgtgggtggggggaaggttttctgggtttagaagctagtttttgcagacattaggaacagaccaatgtcttaaaaggaggtgggggaagggctgcagagatggccccgtggctggggcactggttgctctggggaggatctggatgccaggcacacacatgttgtaaatacatacatgcaaacactcacacgcatacaataaacaggactagatcttgaagtgaacttgctatttcagaagaattagtatggagaatctacttacaaggcaagcacaatggggcacactggaaaccctgtcttgaaaaactaaagaaaatagaaatgaagctgaagaggggaacaaatcatgcatgaggaccaaggaggtacgggctggaagcctcccccaagaggtgacaagcaggtggagaggcctgggaggggctgagaaagcctgcagctgtctgctagcatttggtgcccactcagcttcctgtcagcacttcctctcaccagcacctgcaagcctggctgtttcaggtatgaaggctaagacacagaccacttccgctgccaacacagagactttaatctccaggaagaacaaagaatacacacatcagcccttctggcctagagccaacataggacaccaccttcctctccccctccccagcacagcccaaacaacaatcaagtcaatgttgtggtaggaatttgtatttttcgcctttgttgagaatacatgagattggtaaatatgtcacatgcctttggtggaagtacaactcttactactatacataaactgtgagactgggttaggaaagagacagaggtaatgacagacacgatggaagccccacatcatcccatggcaaacaaagaggagatgtgggaagcttggcttcaactgactgcaaagtcccagggttagctgcatatttgctcatgcacatgggtggtgggagggagagaagactgcagagacacagaagggggttcagggtgaggtgagatagaaagtaggactaacacccccagaagaacgaatgccaactacacctaagccttagatggacagaaacccaggaaataattcccgtgctggggctgggtgggccaacagggaacatacgctccaggcttgggacacaccaaggacaatgttgcttcttctccagaggtggctccctgcactaggcaaagggaagcccagagcagagtggagaccttcgggggacattgggaggctacactgactgctttcttccagctcttcagccctgccctgaggcagcacgaagggaaggtggaaaatgggccaagggaaaggaaggatcgatggctctgcagaacgaaaggctgctgcgtgggaagtggacccccggcctagcacggccctgcctcctccagtttgtggaccagagcacagaaggaatagaggtctgagaacattgccctcctcttcccaccctgccctccacccgccgggcacctggctttgtcccatgcgggatcctatcatgacactagaagaagcccccaagacagactgtgcagctcctatcctcggctccaacaaacacagcatgcaaagggagtgaaagacaggaggcaatgcagaatggatgggcacagcggctgcagggagaactaacggaagagtggcaggcagctgcggatgcgaggcccatgccgcacagcagcgcaacggcacaccaacacagcctggaccctcctatccaaaactgagctgcgggatcagtggacttctctaactctggaaaggccctcctgcctccccccgtgttacatacagggtagtgtggaggaaagtgttctgtggcagcctgggagtcttgccatgcagctctcatttctcgtgatcaacaacaagggagggacaggcctttcattagtgagatggcaagaagcacactcctgaaagcttgttattttccaagcccctgattccctgaaattatttggtgccttcatgaataacatcaaatgcttcaggtgacatgaagagaagcatgtgggatggcttctaggagaaggtaagagtgtcctggtgtttttacaaccagaaagtacgcctttcctaggcctacagagaacaaagcgagcgaaaggctgtaaagttccccacagacacagaaaatcctgtactgacatgtaaagagtagctacaaaatacaagtctgactttttctaaaagggatttgaagttggtctttaaacagacctctgggaccaaaggcaggcctggtatgggagaaaagtttcaaataaggacaacagttcccaactaatatatacatatacatgtgcatgtacatatacatgtgcatatacacatgcactggcagcaagctactacttcccaactattcttgctcccctcctgccaaaggccagcctttcttggagacaccatggacacaaatacccttctcctcccctcagctatgctaacttctcagacacttcacctctgccattcccggccccctccttccctttggccacaactcttttaagctccaggcacacgataaatgggtaaggaggaggtgccagccgttgtcttcgggtagtgacttcaggactggaccacgagcagcatttctagttttgaggaagggtgcaaatgaacgcaacagtaaaggaagggtcatggagaagcctgggccaggatggagaacggaggatggaggagtttgttgagaaagcaaacagaggggaagagacatgagcttgggtggcaatggagaacagggaagggatggcacattctcaagtaaaaaagtagactggacacaggaaccagcaagtcccagacggagaaggaaaaaagagacaggagagaacaagagggcaagttacagcacatcaccagacattcaggtctctcagtaacaggcaccccagccccaaggtctcccttggacccaagctagtggcaaacagctcaacccacctcctcagcagaaggggcaatctcccacaatcctttgcaggggggcggcttgtccatcaaggaatgtccttgtttttgcccttcctccctcccaaaccagacgacgatcccccagtagccgtctccatacctctgcagagcggccccactccccaggcaggcaggcaggcaggcaggcagggctgggagaagtctccaggaccttcccacctcttcaccccatcagcgacctcagcgatacttacttacaatcactaccacgatgatggcacagatagctcccagcatgatcatcatctgaggagacagatggggacagagcatgagcccttgcactcagagatgggaccacccacaggcctctgcctcttgtacggtcacaacctcaggagcataggacctgcagcctcatgttgtttacttcctgttgcctgtttgtttttttctcttggaattccaatggatgggcaaactttgtgaagtacctgctcaggctacagaagttgtggatgtttaaatacatatactgagccagtgtatggctgctgggtgtctgaggaaagagccaggtgagactttctgcagaagatactaaatgagaaagagctacctcactagtctaaattctgagttcctctacctagggctttcttagtggttctgttactctagcctaccctggtggccaacacaggtactacatatcaaggaggcttccagatttcagaggaaagaaaatgagaagttaatggctctcttgcctcctgagaggggagcgaggcaggaaaagctggagggggcagggaatctcaccttgcagtttttccaccagtacttcctttttagcttggcagcactgctctcaaattgtgatgctccggcctgcaaggcgtcagcccggtcatccagctctgacaacttctggtccctctccaagaccttgtccacattcacacgcatgatgtccaccacctaaggagattgcagaaataaagacgctgagatttcccccctagagaccgagaaaatgaataatgcctgggagatcacaagccaaggcctttggatccatggcacactttgccccaccccaccccctgagcctctcccctataaaaaagaggaagatgggtaaaccgatccttgacttagacactctcacggagggtgccaggcgcctacctcctccacttgtgcctgggtctgctgtaaccgcctgttactggtcatgttgggaggaggaccaggaggacccccaccaggggcagctccttctgtcccttcagcaggcggttgagctggagcagacctgtggagagaggcaaacagtacacaacgtaactgagacaagaaaagaatcctatgcatcctcacctcacaccaccaaagcaaatgctgattgaaaacggaaggcattttagctcctcagccacccccaagtactgagaggcaaactcagacacatcctctggcacaatggccatagggacaaatatgccagccttgacctagatggaatttgcctggccactacaagctcctcacatgaaataagatgggacaacccaatccaggggaagagaaatttgtagaaaacattaaatcgtaaggccacgtgaatctgaagtgtgaatatgaaaggggcaagtcgacggtcctgcttggggcagggtctggttcccggttgggcttcacactgtagttggaacatcacggctgctgcaaagacagtttggagaatcaccaaaagcaaagtctgtataggtggagtgaatccaagccggttgttctgttcttggcagagaagccaggagtttcatttaaaatgaatctgagacctaaaacaattatactagtcgttccgaaaagcacagaccagaaataaaaatgctagaaacagtcctcagtgtacacacagcagacactctgtccattcatcttcagactgggcgatgtctcaggatagttacccagtcccgtgtcagataaggaagcttgaactacactgctgtgagttcaagtctctccaccagcaccgctgagggcaaagcgttcccacggccttagaagggaataatccagagtgggtttggtttggtttggtttggtttgtgtttcgggtgttttgttttgagatgaggtctcacgaagccctgggtgtcctggaactctctatgtagaccaggctagcctgaaatacagatctatctgcctctgcctccccatctgctggggttaaagcaacggtggggcctgaagatgaactcctctctgacagtcaccagctaacgagttcccagagttaaacccacagaagcaaggtaaagagagaaagctaaaatttgatggggaatagaaatttcttaagtgctaaaaaaaaaaaaaatctttgctagaaaagtccaagaataagtacagtaaaggttaagccaccagaaagttgctaaaaaaaaagtaaattccttgattaattacaacagaaccaagatgcagaatctctttttccataactaagggaaatgttctagacacgatgtaataaccccaaccgcttctcggccttttggctaagatcaagatgtagaagcccctcagaaagactctattagcagattacaccagcttcttccacttaaagggccgctttcccatttccttcctaaacatagaggaatctgcaaagccatgggagccacaggatctgcactgctactgagctagctaagcaatctagttctagaccagagggagggatttcaatgagttggtagcagctagtgttggaaggtgtccaggatggtggcaccaatgacaagattaaggtcagagacctcgtgattccctgctagccaccatgctttctcaacctccttccaaacatcacacatgaaactacctgcagccagtcaactaagaaggacccctcccctcccctaaacatctagatctatgggcttgtaaaaactgcacagaatgttaatgcagagaacggataaaatggctgtgaagctttggagaactcactttatttactatttgtggcaggtagaaacactccaccctaacctattcagggagttataacccttatgtaatacaaaatcctgccccccttttgccaatagaggcaacacaagcagagtgtagtggtgcacacctttaatcccagcacttggaagccaggggcaggtggatctctgagttcaaggccagccttgtctatagagggaattctgagacagccaggggtacacagagaaaccctatatggaaaagccaaacaaagaagggggatagagagagcgaggaagagggagagagagaggaagagggagagagagaggaagagggaacaaacacaaataaatctagcaccaggcaagagattcagataataaatgaaaagaaagaaaattcttcattgtgtgtatgtgatcctaaagggaagttcttaatttatctggccacagaaggggatgatgccaaaaagagctaaaggctaaactatgtgttttggataaaatgaagaattcactgttctccctatttctcctccaatatttatttggctaggacttgatcactggaaatcgccttagcataaacagctgcattaagatttcataccactgtcccctgagactttctgagctactcgcaaggcgccacagaactagcaagttaagtttctgcagctttgctcacagccatgaggcaggtacatcacactctgggtgaggggcatgcataacgcagagactgcgggcactccaagtcaagaatggacaggaacacctataagtcttcccagaggctttaagagtctgtcaaacaagaaagggtctccgagtttcctgtctgaatctatacctcccccactttttcccctttggggttccacgatacaaagacaagaggggagggtgcggtgtacgtgggacccccgcgccctcgccctgccatggagtgccagctgcagttggtgcgggatggagcgctgcccgcagtccggggtggcccggtctgggggcggcgcgagctggtggttcccggcgtcgccgcagctgctgcaatgcgccatttcccgtcccgcagagtcggacactgcgggggagagtcggtaaagaggtgtcgaggaccctagagcagagtcaactcacatttttctgaaagaggaagtggaggtccgtcccctctctggagaatgcaacgagacgggcagggagacactgcggctgaagcagacggaactgtcgagcgccgcctcacacgaaacacccggaactctaactgcggtggaacttactgcaggtgcagggccggctctcggctttattagacatgaccacgcctctcggatgatgtcaaaacctccaggtccaatcctcgtgagaaatggcctgctagtcccgcccccacaactacagcaattaccattgtcctcttatttctatttcttcactgaccaatacaaaagtggcttgcttaaagtccagctcaaactctgtctccgccgctgagttagaccttttatggtgcctaccagccaatcgctgagctggagactgctgtcattcttaccgctcccgcccacagcacctggcagaaggaaacccaagtgacttagacgctggaatccaactggctgcgaggttcagcagtgaatgcatattcatgaagtccttggccacaggaccaccccgtcaccatccctgcctgagaccataaaacccacattcttcattcttctcttccctatcacgaacttcatccctaaacctgttaacacagcgacttagttaacccagcccagaaacctgaactaaagtagacttccctattttatgtttatgctttgttttgttttttgagacctctctctatagatagatagatagatagatagatagatagatatagatatatacatatatacagatatatagatacacacacacatatatatgtgtgtatatatatatatacacacatatatgtatatatatatacacacacattatgcgtatgtatgtgtgtgtatatatatatatatatatacaccaccacacacacacacacacacatatgtatatatatattatggtacaagtttctgcctgcatctatgcatgcttgggtgcccttggaggccagaggagggttattccctagatggttttgagtatatgtgagtgctgggaaccaaaccctctgcaaaagcaatatgctccctccaccactgagccatctctctccagccccagccctttcctctttactcctcctccaaaatctaagtagaatcaatttttccttctcaatacttaaagacgtttcttctctcttccagtagaatccctttcctagacatcagttgtaaaattcaacattattttatgcttcacagctttaaaggaatctatagctgtggttgcgttttcctagccttagaattcttattttacatttagtggaagcttaggttttggatgcagtgtaaatgtttatatcttaggcatccatgcaaaaggaaagagaacatagtaacattaataggacagttacaacttgacgttcagagactcttttcccagcagaaacagaggcttgtgtagtccaggctggcttcaaacatgaaatgtagtcaagaatgaccttgaaattctggtcctcctacttctgcctcctgaatgctaggactgcagaagtttaccaccatgcccagttttctgcagcgctggtcagcgtactctgttccttttgcatgctaggcattcactctgccaactgagctccatccccatcccccagagactaactctcaggcaatcatgtgtttcactcagatgtccacatgttggtgtcctgtgtgcaagcgtttacgtctttggagatgcatgcagcatttcattactggacaggacatactccttttctccctctggaacttcctttcaagggcctggcattcattctgcaagttgtgacattttgatgttcatgagcaggtatgacaaatacagtgtgggtagagcctgactaagctacagcaaaatttctgccaaatggcaaaagaaagacggaacggaaaaggggggacaattctagattcaagcctgtgtccagtcttgttaccgggtacctacctaattaccacaaatgccattcacggctatttttcttctctaaacttgttactttagatctgacccctgccctgttttttattctgttgcactttacaattgatgattttggttttgattttggatttcaagacacggtttctctgtgtagtcctgggtgttctggaactcgctttgtaaagcaggctgacttcatactcagagatccgcctgcctctgcctcctgagtgctgggattaaatgtgggcattactgctgcccgcttttagatcattttgcctcatggcaggtatgacttggttcggttttctgccgtattcccacctcagcccccccagcccccgccaagtgctgggatgacactgaataggaattttaaaagtatgttcatgagctgatgagaaagaaaacatggactaaaggtcaaacaagtgaaagctgacatctggagaggcagctgagcattgctcttgagcgtggtggcctcgtggggtagcagcatagcataggaaacagcatgatggtcttactcaaagttcaatccctaacagaaagcccctacataaagttggaatccctatattggtaactaagggagtttttaaagtactggcccccgcatgctcttcaattgaaattatttacaaactaggtggctgctgaagctctctttgtccttttaaatatttgaattcataaccttgaactgtgtttttaatactttgcctgaaatccttgttttattcacttctgagagccttagcatcttttcttcctaaaatcatcctggcaagaatctccaagtggtctggcattgacagtggcacccagcaccagcaagagcaatgcagacctccctggtaagctcctcttcagtggaggccttggggaatttccacagagacagttccaagagaaataaattgtggtcatatgctgaaaacaaatcagggaagaaatgccaagaaacagagagacagagacacgaattaaggaaattaaaaagccatgccaagtagttcaacgtctgagtaataaagaatatgaaaagggggaaattgggatgtatgggaaaaggaaatgtgtgggcagggaattaattatcctgaactaaatgagcttgtccagaccaacttgtgggttctagctaccacaatgacagaaaaagaatagcattaaattagacacatctttctgtaatctcagaacaggagagcaaaacaggaggttttgaaatctttcaacaagagaataaacatgggacaggagggagaacagcaccatcagtgcaggcgaatagtgcagcagcgcctaaagagctttcaggggctagagaggctcgacaggatgagaaccgtctgctcttccaggagacccaggtttgcttcccagctggcaaatggtgcctcacaaccatttttaactccagttccagtggatctggagccctcacacacacacacacacacacacacacacacacacacacacacacaaaaataaataaatatttttaacctgggcaaaatgattattaacctagaattttatatcatctcaaatattaataaaggtgagggggaaccagggctctgatgtcatctacctgtaatttcaccacacagaagagaatggagaagaggatcacttgaggctagaagatcaactcctaacaagacccagtctcaaaaaaaggtggaactaaagatgtcattcagataatgtagggagtcagaaatgttaccatctcccctgtcgaaacagtccactgtgtgatgggctctggaaaataggagagagacaggcgacagttctaaggcatggaacggagggtcgtaacaaaatgcttgaaatggaaaccgtactaaggatcaagatacaacctgccctgactagattagaagaaggaagccgggggtggtggcacacgcctttaatcccagtgcttgggaggcagaggcaggtggatttctgagttcaagtctataaagtctatttctgagttcaagcctggtctataaagtgagttccaggacagccagggctagacagagaaaccctgtctcaaaaacaaaacaaacaaaacaaaaaaacaaaaaacaaaaacaaaagaaggagaagaagaaaggagaaggaggaggaggaggaagaggaagaggagaagaagaagaaggaagaggaggaggaggaggtaagccctcagtatacagtcttcaggcaaggcattaatgcaatatctgacatgcttaggcatttggaaactgtcttggttagttttctattactatgaggaaacaccatgaccgaggcaagttgtaaaagaaagcgtttagcttgggtagccacggaccatcatggcccatcatggcagggaacatagctacaggctggctagagtttatatctggtcccacaaacctgaggcagagagagtgagagagcttacctgaggcagagagtgagagagctcagtaagaatggtggggatttagaaactccaaagctcacccccagtgacacacctcctccagcagggccacagcttcaaacagttcttacagagttccaccaactgatgaccaagacttaaaacctatcgggaccattctcatgtaaaccaccagagaaactaaggcaagtgtttcacagatctaattgggtataacttagggataaatagtatggtttttttgttttgttttgtttagttttaagtttcaatgatgtattgcttttctcatatatgtgtgtgcgtgttatttatttattttatgcatatgagtatactgtaactgtcttcagatgcaccagaagaaggcatcagatcccattacagacagttgtaagccaccgtatggttgctgggaattgaactcaggacctctggaacagtagtcagtgctcttaaccactgagccatctatctagcccatgttgtttttctttttctttttttctttttttctttttttccatgttgattttctttactgttattttatgtgtatgttttgctggaacttgtgtctatctacgcatgaatacagtgcctgtaaaggccagaagagggagcctgagcctggagttacatatggttgagctgtcatgtgagtactaggaattgaacccaggtcccctagaagagcaaccaggctcctaggggctgagtcatctctctagccccaaaacttaaaacttctgtcttaagataatggaatcttaaaaagaaaagaaagttactgaataggaaaaacatttcaaataatatatctaataaagaacttctatctaaaaaagaagagggctggtgagatggctcagtgggtaagagcacccgactgctcttccaaaggtccagagttcaaatcccagcaaccacatggtggctcacaaccatccgtaatgagatctgactccctcttctggagtgtctgaagatagctacagtgtacttacatataataaataaataagtctgaaaataaaataaaaataaaaaagaagaaagaaaaaaacttctgtctgtgatagataacaaacctgtgcagttcaaaaagaaactaatttgagccacatggtgcatacctttactcccagcagaggagagaggagagagagaaattagtttgaaaataggcaaaggacgtgtttagacacaaaatgccaatagacactagaaaagatgccctgtgtcataaccatcagagaaatgcaaataaaaactacattgagataccagttcaccccccacaaatgctgaaaaactctcaaagtattgtcaagaatcttgacaaatgacatcttcatacatcgctagtaggaatacaaaatagtgcatttgttgtcttgaaaagtttcaaaattgctcaaatagtgtacccaagaaaaaagaagatacaaacacacacactcacaaacttgtacgtgatgcaagcgctcagaatttggggttcaagagaaactaagtagattgtgttttgagggagagatttcttaggagtgctatcaatgccagagaaagatagcacgacagaatctcctcttacaggtttcagagacctgaggaggccccatgtctgtagttgatgagtagcctacagtatgatatgatctacagtcagattgtctctgattcctggggagtcaggaaaaggtttggaccttcagttaatgtgtgtctgtcatatgggaagtgtagtggtttgaatgagagggctgctgtaggattgtgtatttgaatgcttgtccctagttggtggaactgtttgggaaggattaggaggtgtgaggccttgttggagaaggtgtgtcactggggtggactttgaagtttcaaaagcctgggccaggtccagttagctttcttactgcctcatgtttgtggatcagatgcaaattatcagctactgctccagcgtcatgcctgtctccctgtgttccatgtttcccaccttgatgatcatggaccctaaactgtaggcaagccccccacctcccaataaactctttcttgtgtaaattgcatcggtgactatgtgccctcaaagcaatagaaaaataatttaagacaggaggtatcacttaacagctcctaagaacttctagtcccaagtagtcatgtatttatgataaacttccatgaaacattcacaatacataaaaaagcagacagcagtaggtgttcagttctgggagggttaactgggataactggaaataatggctgagggagagatgatggaaatatcaaaacttgggggctgtggtccagatgtaaagtgagtaaataaattaatggggaaaaggaaaatatctaaagtcaattatggtgataggcacacaactctaaacagacaaaaagtttccaaagtcagtgaattgtatgatgcataaattacgtccctgtaaaagagttttgatctctcctactgccctataaggaaggcattctcccatgactctctcgccctccctgggtctttcctcccaccagcaggcagctctcaccatgagggtttcagcagatacaagatctaccccaaacaaggacagaactacaccaggactgaccaggaggtttcccagtttctgaacgcaaaatgcaagtgcacatgtcttttctaaaaggaatccttggcagataaattggactgtcctctacaggataaaaaaaaaaaaaaaaaaaagaacagttggaagaaattcagaaggaaagaagccaccgccaagtccatcgggccgtcactggcacatcttttgaggatataatgaccaaaagaattcagaaaccagaacttagggaagctcagagagagcaagataacatgtaagcaaaaggctgaagcctggatggcctctcctccccaaggtaaagagagtattaattaggtagatcagagtcttaaataaagatccatttgtgggggctggagagatggctcagcagttaagagctctggctgctcttccagaggtcctgagttcaaatctcagcacccacactacaactcacaactgtctgcccctccaattctaggggatctggcaccttcaaacatacacgggggcaaaataccaatgcacatagaataaaaataaataaatctcttttaaaaagatccatttgaggcaggtgtggtggtgcacacctttaatcccagcactcaggaggcaggggcaggtggatttctgagttcgaggccagcctgatctacaaagtgagttccaggacagccagggctgtacagagaaaccctgtctcgaaaacaaaacaaaacaaaacaaaacaaaacaaaacaaaacaaaagatccatttgtgattttaaaaaaaaagtttaataacataattgttcccgttaaacataactcagctcaaaataatatttatttatttatttatttatttatttatttatttggttttcgagacagggtttctctgtgtagctctggctgacctggaactcactctgtagaccaagctggactggaattcagaaatccacctgcctctgcctcccaagggctgagattacaggcaaaataatatttatgaattcctaataatttaaacactgcttaccaatttaagccaaagtaatgatattagtaaaagtaggaaggaagagatgtggagtgaaagagaaaaggagagagagagagggaggcgtgacccagcgtcctggcaagatgagttcttcctgtgaatagctgccagctctcttccaaaaccgtacctggggctggggaggtggctcaccggaaaaagtgctaactgtgcaaacctaaggacttgaacaagatccatcgcccactgaaaagccaggtgcagcagagcatacatctgtgacccaagtgctgggccacagagaccggtacatcctgggccctcagtggccagccagtctagccaacagaacatactccagctccagtaacagacttgtctcaaaaactaaggtggaagggccagatgtgttggcacatactgccactcaggtggcagacacagacagatctcactgagcttgagatcaatctagtctacctagagtttccaggctagtcagggctacatatagatagactgagagactaaagttttgggttcagactccatctcagaaaacctgacatgtttgaactcaagtacactaacagactggtacctagctccagtttccaggttacctcccaacaaaaactgagcctaagtccagtttccaggctacccccccaccccacccccaacaagatctgggtctccaggttaccctccccaacaaacacagtgtctagcaccagtctctagcccccaacaaatctggcacacacaccccaccccaggttacaagcccgcccctgcctaacaaccaccaatcaggaggaaaacagaagttaagtttatggtttggctcccagcaccagccaatttatgctaaaggccacagtagccatcaattagatgcttgccaggccagaaacactcactcctcgcttgccattttcaataaaactttgtccggatgagtgctttcactccaccaaaaccgtcctgtgggtcagaggcagtgagttaagccaagctcaagtttgaataaagacaccctaatgcattgaattcagctcccttggtggtcttttggggttcaggaaagttttggcacaataagatcatgcttcagaaaaagaaaagaacaaagaaaaggagagtgagagcgagtaggggaggagggggtagggggagagtctcagcaggtagagcacattgcacacaggcctttaatcccagcattagggaggcagaggcaggcagatctctgagatcgaggccagcctggtcaacagagtgagttccaagacagccagggctacacagagaaactctgtcttaaaaacaaacaaacaaaacaaaaacaaaaaactgccaggcgtggtggcacacacctttaatctcagcactctggaggcaagaggcaggcggatttctgagttcgaggccagcatggtctacaaagtaagttccaagacagccagggctacacagagaaaccctgtctcgaaaaacaaaacaaaacaaaacaaaacaaaagtctaaaatcagctgctggtggcgcacacttttaatcccagcattcagaaggcagaggcagacagaactcaggtctaaagagcaagttccaggccagccaggattacacagagaaaccttgtcttgaaaaaccagaaaaggaaatatggaagtgtttgtttctagaaagaacatgggtgggtagaggggaggggaggattgctctgtctcataacattttctagtcttttctactagctgggctcttgtatgacttttatttggaaaatataaatcaagtattcagtcccttccccctacgagtccccccctcccctcttcctcctcctcctcttcatttttgtttttcaagggcttctctctggagcccaagctggccttacatttgggtcaatcttcttccctgggcttgcctgggattgcaggtgtgaccaccaggcctggctcctccccttttctgagctgtagttcacacaccatgtaattcactccttcgttttcatttaattttattggtgtgtattcttttaggtctcacggagcccaggctagcgttgagcttctgcccctcctgccggcacatcccaaaagtgctgggattgtagacacgtatcaccatctccagtaaaaatccaaactggttagttttggttggttggttggttggttgactgattggttttagttttgggtttgtttgggttttgtttttgttgttattgttgtttgtttgtttttgttgttgttttgttttgagacaaagtctgactatatagctctggctattctgggactctctgtagaccaggctgtcctcaaactcacagatatttgattgcctctgcctcccgagtgttgggattaaagcagggtgtgaccatgaccagttctaaagtggttatttttacccccttgtcttaaatttgaacctagggcctcaagcatgctggctcagctgtactactgagcgacatcatggtcccttcaagaggttttcagtatataccttgttcgaccatcactactaccgtacccaatttgtggttgttaagttttgaggcagagtcttggtatgtaagttactggttctcacactgtagaccaacttcaagcttgcctctacctcctgaggggcaggattgtgaacatgtggaaattgctccttaaaaactccatatgttgaaccgggcgtggtggcgcacacctttaatcccagcactcggtaggcagaggcaggcggatttctgagttcgaggccagcctggtctacagagtgagttccaggacagccagggctacacagagaaaccctgtctcgaaaaaaccaaaaaaaaaaactccatatgttaaacttcccacccagtattggggattaaacctagggcctcacacatactaagcaagaactctaccactaagctatagcctcagtccacagttttgagttgtatgtgctgaagctagagagatggctcagcagtttaaagcacttactattctagagaacctgagtttagttctcagcacccacacatcaggcagctgatgtgtggatgtgtaactccagcatcaggggaatcccacagcctcttctggcttctgcagtcacatgaatatgtgtggctgactttcccaaacacacacacatacacaaaaataaatgaagagtttttaaaattatattatttatgttttgaaaataagtaataagggctagagatgctagctgctctcccaaaggtcctaggtttgatcccaggacccacaaccaacccttcatagtaccagccccaggggacgttatgtcctcttctggccaccaaaggcacttatatggtgcacagacatgcaggccaaacactcatacacataaaataataaataaatctttctaaattttctacacatttgctttttgttttggcttattgtagttggattttggttggtttcatgcagcgctgagtgaggacccagcccagactcttgtacacgctaggcaagcactctcccaactaaatcataacctcaaccttattaaagaaatcttcaaaaaataaaaataaagtcatatatgtttatggtacacagcatgatgtcttttttaaatatatttctttgcttttttgtgttctttttaaagaattatttattttatgtatatgagtacattgtacccgtcttcagacacaccagaagagggtgtcagatctcattaaggatggttgtgagccaccatgtggttgctgggatttgaactcaggaccttcggaagagcattcagtgctcttaactgatgagccatctctccagccccagcatgatgttttaaagatatatacacttaggatagaaaaaataataaatggctaaacattgaacattgtcttacttatgtcttgtggatagccctggagctaattatatttgatgttaattccattctcctatgagtggttgagaacaaggactgagtcagtcactgagtgatttcctgtaaacctgctacccaccttaatttgtaaaataaaggagaactgaagattgggcagataaaaaggaaggtggagtggaaggtgagaggaagagaagaaggagaaaatagaagatagaaaaaattggagcagaagcacaaggcctggagaaaccgcaagttctaaggggtctcatagatgtggaagatggtagtgtagcggtagatctgcccaatctaggcgcacagcatgtaatcatattaattgtgttgtgttttcattgctggggcatatttgggttggagaaatttaccgcaacaaaatggtgcccaacgcattgatttgaattcaactaacctgagataaaaattcactgacgcccaacccctgaatggggtttgacagtgacctaggctgtagcagtatggatttgaagctgactagatttaagggtcctacagaggacagcagagaagcatctatgtctgaaagagcctttctgtgtttgcttccctgtatccttcgctccccaccctgcctcccccatctccaaacaaggacacagacaacacacgggtctttttacactcagcttctccctgtgaataaagaattgggagacaaaggtacaaaggactccggaccaggtaattcatttctataaagagagaaatatcaccttttgatacttgaagaaggtataaagatatggtgctctaataagtcttatgggatagtcatattctgtctaacgtgggctccatgggaattttgggtttaaatcctggtttgacaagttgcctcttataagtaggtgtagtacctaaagataggaaatttcacctgcggttcaaaaccaaatagggaatattagtcactaactccaagtagagagagcagtgataatcacctgctatgaacaggaattatttaatagaagtctggggctctaggtaaagagcataacagatattataataggtattaataaaataaatgtctgtggctcaagttagagagcaccctaataagtcttacaggatattcatattctgtctaacgtgggctccatggaaattttgagtttaaatcctggtttgacttgacaaattagaaaagcctaaataggctaaaatgtgtgtgattttgagtattgtggttgttttattgttcctctgggacagagggcaagctccaggtttcctagttaccagctgaaggatgtaggatgctgatttgggggaaaggttttgtctttgtgtttttggaaaaggtgatgaaggtgtttacaccttccagagttctatggatcagatttgatagagggagaccccctgagaactagattccagagaatcaaacaaaaaggttttcttgatgatactaaaattttgttttgagatttatatat

SEQ ID NO: 24 - DNA, 1290 bp, Mus musculus
agccacaactgccttcaaaggtcggtttaccacccaagtggagtcgcagtggctgctgcccagagcacataggagccaccagtgactcggtacaagcagttggggctcagaaaagatctccctgggcaggagctatggcatggccacctccctactggctctgcatgctggggaccttggtaggactctcagctaccctagccccaaacagctgtccagacaaacactactggactgggggaggactctgctgccggatgtgtgagccaggtacattctttgtgaaggactgtgaacaagacagaacagctgctcagtgtgatccctgtataccaggcacctccttctctccagactaccacacccggccccactgcgagagctgcaggcattgtaactctggttttcttatccgcaactgcacagtcactgccaatgctgagtgcagctgttccaagaactggcagtgcagggaccaggaatgtacagagtgtgaccctcctctaaaccctgcactgaccagacagccatctgagaccccgagcccacagccaccacccacccacttacctcatggcacagcccatagacccctgtgcagctcggactgcatccggatctttgtgaccttctccagcatgtttcttatcttcgtcctgggtgcaatcttgttcttccatcaaagaagaaaccacgggccaaatgaagaccggcaggcagtgcctgaagagccttgtccttacagctgccccagggaagaggagggcagtgctatccctatccaggaggactaccggaaacccgagcctgctttctacccttgaccgggtgctggtggggccctttctgacgaggggccatccacagagacctcaatggtggcctgctcccctgtcatggtcatcagaaccctttcctgtgaatactcaacaaactgcccttctgagaccaacagggacaagagcaggatcccagtgtgtggcccagcaagctggggagactcaggctctagctataaagcacacttactctaagtgaaaccgtccagctgacaaaactacatgccaggggtggaaatggctcaccaagggctccagagggggcttggcagtgaggagcacgaagtgttcctccagaggaccagagtttgattcccagcactgtcaaatggatcgaaaccagctgtaactctactttcagagggtctgacacctttgacctcctctggcatctacaaacacaggacacacacacaacacacacacacacatatacacacacacacacaca

SEQ ID NO: 25 - protein, 271 aa, Mus musculus
PQLPSKVGLPPKWSRSGCCPEHIGATSDSVQAVGAQKRSPWAGAMAWPPPYWLCMLGTLVGLSATLAPNSCPDKHYWTGGGLCCRMCEPGTFFVKDCEQDRTAAQCDPCIPGTSFSPDYHWHCESCRHCNSGFLIRNCTVTANAECSCSKNWQCRDQECTECDPPLNPALTRQPSETPSPQPPPTHLPHGTAHRPLCSSDCIRIFVTFSSMFLIFVLGAILFFHQRRNHGPNEDRQAVPEEPCPYSCPREEEGSAIPIQEDYRKPEPAFYP

SEQ ID NO: 26 - DNA, 26815 bp, Homo sapiens
gcacggccctaggaaggaagctgccctaagagctcaggctcagacaccgcaccacggactagcaggggaaacaaaggtcttaggtccctctcagggctcacagtcatgaggctcagaaacagctggggaaagtggggcgtgcctccctccccgccacagggaggatcaccagactggctccatgagccatttccctcatctggtgagcaagggaagtcactcagaagagcaagaatggcccagccacccagcacggtggctcacacctgtaatcccagcattttaggaggcaaaggtgggcagatcacttgagctcaagagttcgagaccagcctggggaacatggtgaaactccatctctacaaaaaatacaaaaattagctgggcttgcagggcacggtggctcacgcttgtaatcccagcactttgggaggccaaggctggcggatcacctgacatcgggagtttgagaccagcctgaacaacatggagaaaccctgtctctactaaaaatacaaaattagctgggcgtggtggcgcatgcctgtaatcccagctactctggaggctgaggcgggagaatcgcttgaacccaggagggagaggttgcagtgagcagagatcgcgccattgcactccagcctaggcagcaagagcggaactccatctcaaaaaaaataaattaattaattatctgggcttggtggcgcatgcctatagtcacagatattttggggggctgaagcaggaggattgcttgagttcagaaggtcgaggctacagtgagccgagatggtgccactgcactccagcctgggtgacagagcaagaccctgtttcaaaaaaaaaaaaaaaaagcgagtagaaaatgccaggggcagttgggcacagtggcttacgcctctaatcctagcactttgggaggccaaggcgggtggatcacctgaggtcaggagttcagaccagcctggtcaacatggtgaaaccccgtctctactaagaatacaaaaattagccaggagtggtagcgcatgcctgtgatcccagctacttgggaggctgagacaggagaattgcttgaacctgggaggtggaggttgcagtgagccaagatcttgccactgcactccagcctcggtgacagagtgagactccatctcaaaaaaagaaagaaaaaaaatgccaggggcccaggagcctactgtgagaggaaacgtcccgtcgccttgtgaaatcatgattctgcgtgatgaagaaccgagtatgaataatacatacagagcagacatatcgcctatgcacagcttgttcaatttagtgagtcgttctgtctctttcacactcctttggtttcgttcccaggttaactagctgttccctcaaccccatttcttgggacttgcagcctcaaataccaaggaagagagaggaggaatgaatatttattgagtacccaaacaagacaagaccagacatttcatttctattgttacccttaattgtcccaacatgctgcaaagtgcacgacactatcctcaagcagatgaggactcagtcaagaggttgtgggacatgctggacatgatgcgggtagtagccggcagagaggcatttggaccaccaacctgtctggttgtgaaagtcaagctctctccacctatcccaggatcctcctgtctcagtgggtttgggccctggaaccacccttcagttccaggtcaagactgctcccttcatagcgacatctttccctcactgtttctccccttgcctggtatctgagaaattccttttataggtcttgcccttccctggctacatagactgagagtcagaaaacctcagtagtcagcactcaaaccttacacctaacaatttacataatatctgatttcagaaattagctttacctcagatcaaaattaatcctataaatcacagatcacgtaaaatcacaagtgtgacaagtcccaaaaaagaaagtgtgaccaggctcacgccttgtaatcccagcacttcgggaggcaaaggtgggaggattgcttgagcccaggaatttaaggccagcctgggctacatagcaagactttgtctctacaaaaagataacaaataaaaaaaaaaattagccaggtgtggtcccagctactcgagaggctgaggcaagaggattgcttgagcccaggagattgaggctgtattgagctgtgttgccactgcactccaacctaggcaacagagggagaccctgtctcaaacaaacaaacaaacaaaaaaagaggctgggcatggtggctcacgcctataatcccagcactttgggaggccgaggcaggcggatcacgaggtcaggagattgagaccatcctgatgaacacggtgaaaccctgtctctactaaaaatacaaaaatattagccgggcgtggtggcgggcgcctgtagtcccatctacttgggaggctgaggcgagagaatggcctgaacccaggaggcggagcttgcagtgagccgagatcgcgccactgcactccagcctgggtgacagagcgagactccgtctcaaaaaaaaaacaacaacaacaacaaaaacataactataggtctgtgctcggccaggtatgggggtaaaatttatattacccacgtggttgggaaacctcctttatccccaagaaaagaacatgaaaactggtctcaagccagtgacatccctggggcgtctgacaaaagcaactgcaaaaacactgaagggacatgtactcaacccaaccaccaaggtggcccacagaaaaagcctgttgaatatgcactttctttccctctctctctctctttaatggagatggggtcacactccgtcaccggcactggagtacagtggggtctcactgtgttgcccaggctggtctcaaactcctggcctcaagccatcctcctgcctcagcctccccaagtgctgagattatggtgtgagccactgtgatgggcttgaagatgcacttttgattcaaaattagaaaacacacctgaaacagtctgacctagagaaactttttcatctaagtcagtcataaaaatcaaatatttgtgcttagactcagatcaatctatataaagtgttgaggaaagttttttaataacaaaacacattaaatcatattgctcttactaaatatattactgttaatgttttattatattgtggaaaattttgttacctattaatattttaatgagagcaactagatcttttatgttgcaaataagtaaatgtgatatctttaaaaattgtttttcctatccttatctcattgtttttattttacttttattattttgttgttgttgcccacactggtctcaaactcctgagctcatcgatcctcccacctcagcttcccaaagtgctgggattacaggcatgagccactgcatctagccaatctcatcctttttatgtttctgtatgtgactatgtaattcgatctcatcctttagaactttagaatgtctacatatacttacatagaacctatttgagtatataatatatgattaatttatttaaaatattgtggggagtcgagccagcgtcgccgcagtgatgtcgttggagagcaagcaattcctgacggagctgaccagactctaccagaagtgccggacgttgggcagcgtctatatcaccttgaagaagtatgatggtcgaaccaaacccattccaaagaaaggttctgtggagggctttgagccctcagacaacaagtgtctgttaagagctatcgatgggaaaaagaagatgagcactgtggtgaactccaaggaagtgagtaagtttcagatggcttattcaaacctactgagagctaacatggacgggctgagaagagggacaaaaagagcaaaaggaaaaagaccaaagcagcagcacagtaaagggcacaaattccctgctttcaccaattaaccactgaattgctattttttcctttggtttttacttttggccacatagctaggtttctggttcccccacagtaggtgttttcacataagattagggtcctcttggaaagaatagttgccatgtttacagggtagttgtggtaagaatctagtttattttacatgtgactaattggtctgtgctgcatggttatatactcctggattatagattagaagtctccgaagtcacctctgtgaaaagcaagctatcattaaacatgtctgtttatcaatcaatcaataaataaaatattgtttatttggggatacatgctgaaaatcattttattgatggggtacaaaataaaaaaaaaaagcagagactactgaattagaaatatacattttttcaggcacagatggaacatttacaaccacatactaggccatagagcaaatctcaaacaaatgccagaggattcatatgtattcattttctacagctgctacaacaaattaccacaaacttagtggttgaaaacaacccaaatgtattatgttacagctctacaggtcagaagtctaaaacaggcctcaccaggctacaatcagtgatggcaggtacagctgcccctggaggctgaagggtcaaatccatctccttgccccttccagcttctagaagccgcccacatactgaggctcatggccttcttcttccaacttcaaagtcagcaacatcttgatccttctcatgcagctgcctctctggcgctgtctcctctgcctctttgccacttacaaggatgcttgtgattacactgggtctacctggataatgcagaataatcacccattgcaaggccaaccttgattccatctgcagccttaactcccctttgccatattaacatgcagttcaggggcgcagatgtcctcgggggaccaacgtgctgcctgccatgctacacagacagagtgctcgggccacaataaatttaaaattaaaataataaacaacaaaaagttaagccccacagatctggaaaatttgtaatgcatttataaatgaaatataggtaaaaataaataataacgggaaaagcaaatcaacaataatgaaaaaaacaatatagcaaagctgatgagatgtagctaaagtagatcttcaagggaagtttatagccttaaatgcatatattagaaaataagaaatttctaaattaattaagcatccaatacattagaaaaagaatggcaaagtatgccgggtgcagtggctcacatctgtaatcccagcactttgagaggccaaggtaggtggatcacttgagctcaagagttcgagacaagcctgaccaacatggtgaaaccacgtctctactaacaatacaaaaattagccaggtgtggtggcgcacacctgtaatcccagctactaaggaggctgaggcaggagaatcacttgacctcaggaggaggaggttgcagtgagccaagatcatgccactgcactccagcctgggcaacagagcaagacagcctaaaaaaaataataataataacagtgaaacagctacacacaagcaaatcaagttctaccaggctttcaaggaacagattatccctattgtatataatctgtatataaaaaaataaaaaatagcacttaaaaaacaagtggtcaaagcaaggaaaatagaatcgtgtcacagaaaccaagggaagtaataattctcatgtaggtggagagctgccagatcccacatatctctgttaaactttgcttcctggatgaggcactccctaccccttaaatccccctattaggggtatagacacctatattgcaccccaactctctccttcatagcaataatgaccattactaactaattttaattttgttttgttttttgggttttgtgagatgaggtcttgctctatctcccaggcttgagtgcactggcatgatcatggctcactgcaacctcgaccccctgggctcaagtgatcctcccacctcagccttccgagtggctgggaccacaggcacgtgccaccacacccagttaatttatttttattatgtgtagagacggggtgtcactctgttgcccaggctggtcttaaactcctaggctcaagcaatccttccgcctcggcctcccaacgtgactgggattccaggtgtgagccgcctcacctggccaattttacatttgtctttgagattatatgatcgatgtctgactctcacactggtgtgtcaactccgtcagggcagaaaccacatatttgtctgtttgtttttcatctttgtgccccattacttggctggttcctaacacaaaatgaatgtgcaaaaaacgcttgtcaaatgaatgaggaggtctaaggggccttgagccctctgacgtttccattttataattgtggacagagccgctacagcacaaagctgagctggaccatccaatgtttagccagtgccttacgtgctaggagacactgggagctgtgctgggcttctgaggagtgggcagaggctggaaatacccatagttggtcagtctcctgtgtcacccagactggggaggtgcagaaatgaaaattacagagctgcgaggacccagaacctcattaatgagcttaactcactgtcctgaccaggtggcctctcaaagccttgctgggaaggaggctttaaggtggtgggggcagcagtgctggtggtggtcatcgaagaaagtgggagtcggggaggaagcaatggggagcaggggacaaagagggccagacaaactcagagcttcaggtgatgagactcaggaagcctaagtcaggaacagtgattgcggacatctttgtcccataacagaacttcctcctaaggaaaggtcttgcagagactggtcctgctgagcgctttaacaggttattgattcataaaaattggagaaaaaagacaaagtctgccacacctaacagccttctgtttagagctggtttagaggaaactttaagcaagtcttgtgtccaacaatttgggcctgaggcagggtacaggtaagggaacagacaggagacacggaggcaagaacaagactttagctgaaagagaaatcagagccagaggcagccacaagaacacccaacctactggaactcatgcaggtggacagcctgcccaggacttgccctgagtgggaagcaaagagcatcttatctagattttaaggagcagggtgcccctggctgacatctaggctacagtcactgggccaggtggagggttggtcaggccctctcaaaagtcatgagaggccaggcacagtggctcacgcttgtaatcccaacactttgggaggccgaggagggcagatcacttgaggccaggagtttgagaccagcctggccaacatagtgaaaccccgtctctactaaaaatacaaaaaattagccgggtatggtggccggtgcctataatcccagctacttgggaggctgatgtataagaatcgcttgaacctgggaggcaaaggttgcagtgagctgagatcatgccactgcactccagcctgggcaacagtgagagaccctttctcaaaaaaaaaaaaaaaaaaagaaccaaaaaaagtcatgagagtcctcagagttctcaagaagggctgctgtgggcctgtttctggaaaggaaagaaaagcagggagctgttgagaaaataccatatgtttttatgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcctagcactttgggaggccgaggcaggcagatcacctgaggctaggtgttctggtccagcctggccaacatgacaaaaccccatctctactaaaaatacaaaaaataagctgggcgcggtggctctcccctgtaatcccagccaaggtgggcggatcaacttgaggccagcctgaccaacgtggcaaaactccatctctactaaaaatacaaaaattagctgagcgtggtggcacgcacctgtcatcccagttactcaggaggctgaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaagacatttaccacaacctggaaatggctggtgacagaaaagtcctcagggccacagcactctctgcggtgggaattcaggtgccttgcctgatggtgacaaggctggttttgcataaacagctctctgaatcacacccagatgtggcttctgacttgagtggacccccatgaagagctgcagagggggctgggaaaagacaagagaatggagaaaatgaggagaaaggaaactacagagtgagatagagaacagatctgacaggtgtgaccacagcagtgtgacatttatgaacagtgtggaaacaacggcaaagcccctgaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacagtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcagctctccagcttcctctctgaaatcccagtcccaaaatccagtttcctggccgcctcctggctcaggtcaggatctggcagaggaggtttctcagccggttatgttggggcctgcttaagggcgggggtgagaaaggtccccaggctactgtggatcctgtgtctgacttcagatccccttttcccacagttatagctccacttttttgggacaggtggggagcaaaagggtgcagaggtcaggtcttgaaatcaccaggggatttccgggtgaggtgggtggtgagaaaggaaacagcaagcagggctctggcagctgctgcagacggcttcacacagggacgcgggctgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccagtgagtctgggagtcggggagagctggctgggagaagagctactgaagccccagggtgccaccctccccgagattccagaagagcaaaggggccggggatgaccccatcgccttctaagcccaacgggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttccacctgtgtccttggtcctcccgggctccctccaccaggacagcccaggtcccgattacagccacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgcaggtaagaaaatgaaaagcaaggccaggtgtggtggctcacgcctgtaattccagaattttgggataccgaggtcggtggatcacctgaggtcaggagtttgagatcagcctggtcaacacggtgaaaccccgtctctactaataccaaaattagccgggcatggtggcgggtgcctgtaatcccagctacgagggaggctgaggcaggagaatcgcttgaacccggaaggcagaggttgcggtgagccgagatcacaccatggcacttcagcctgggcaacaagagcgaaactccatctcaaaaaaaaaaaagaaaagaaaagaaaagcaagtcacagaaagttttgcttttctaaagtggtaagatatggggcacagaagaagaaagggaacaaatccacctccatccacactggtcacctcagggcacccctaggccttggtcctttcttcctaaaaacccctgagtcaggccaggtgcgaaggcccatgcctgtaatcccagcactttgggaggccaaggcaggtggatcacctgaggtcaggagttcaagaccagcctggccaacatggtgaaaccccctctctactaaaatacagaaattagccgggcatgatggcaggtgcctgtaatcccagctactcaggagactgagacgggagaatcacttgaacctgagagacggtggttgcagtgagccgagattgcgccactgcactccagcctgggcagctgagtgagacaccgtctcaaaaacaacaacaacaacaaaaaccctgagtccacaagagaatgcttcgcagcccctacctgaacgtccccaggcacacagacaacctgtgttatttccaaaatggagatcgttctcatctcactgggctgccatgaggaaataagacacatgatgctattctgtacatgggtgctgtccactgtagtcttatcgagccaaaacccggttttctcccagtgaaatgctaggctgctctggtgcttcaggggtaaagctcagggatgcatcatttgttcatgatcttattagtaaacccagtacttgccctctccagctcagcacatcctcgagggcacaagaaattgagaacatgatgacagggttccccagagcccattaatccaatactctgtgccctgcttctttgagtctccaagaagaaacagccaagtccagagaaaattaggggcaaccgtcctatccttggaaaaccccagaacactctaacctctctgtggtccaacctaaatctatcctgacccattagaaaaaggtcttcatgtctgtccagtgtctaccatactcctggcatgcgtaggtatttctctctttttattccaaacctacaaaaaaaggtgaaataataatataatgaacacctatataccctacacctagatccaccagttgttaacaatttgccacattctctctcccccgactcctcatgtgtgtatatgtgtacgtgtgtattttcctctgaactgagagtaagttgcagaagataacacttgaaccccaaacgcatgtttgaaccccgaaacgcatgtttaaaccccaaatacatccatagcatgtattagtttacaatgaaggacaaggatgtaatccttcatagttacaaagccatcatgtcagaaacaaaccaaagtggggaagtagtctacccgtagcgcaggcaataagggagtgcagactgtaaaatatttcagaacaaaaataaaatcagctaaaagtcagatggctttatagtctcaccatctcccgacactggcaattctgaatattatcagtgataaaatactcctctctgctagggcagactgtccctatctccccacacgactgcctagtatgccacagatcttcatacttttagatattttttaattgatatgataatagtctcaactataaagtccagggcatggtggtgcacacctgtagtccagctactcaggagactgaggcaggaggattgcttgagcccaggagtttgagtcctgtctgggcaacatagagagcgagaccctctttttttttttttttttttaacagtctcattctgtctcccaggctggagtgcagtggcatgatcttggctcactgcaacctctgcctcccaggttcaagtgattcttgtgcctcagtctcccaagtagctgggattatagacgcccgccaccacaccagctaatttttgtatttttagtagagatggggtttcaccatattggccaggctggtcttgaactcctgacctcaggtgatccacccatctcggcctcccaaagtgttgggattacaggcgtgagccactgtgcccaacctaagacccttctctttaaaaaataattaaatgtctccaaattcaaatttctccacttgtcccaatatttttttttttactgctttttctaagtacacaattcaaacaagaatcatgcagtgcatttagttgtgctgttccttgttttaatctagaacatgtttcatagaattgacatttttgaagggtccaggctagtggtcttgtagagtatcccaacatttagatttgtctgattgttttcctcatttcctcatgactggatttaggttaagcatgtttggcacagatactactatcacatgcttttttttttttttttcgatatggagttttactcttattgcccaggctggagtgcaatggctcgatcttggctcaccacaacctccgcctcctgggttcaagtgattctccacctgagcctcccaagtagctgggattacaggcatgcgccacgacacccagctaatttttgtatttttagtagagacggggtttctccatgttggtcaggctggtctcaaactcccaacctcaggtgatccacccgcctgggcttcccaataccacgtgtgtttttttgttttgttttgttttttacattttttttgagacggagtttcactcgtcgcccagactggagtgcaatggcgcgatcttggctcactgcaacctccacctcccggattcaagcaattctcctgtctcagcctcccaagtagctggaattacaggcacctgccaccatgcccggctaatttttgtgtttttagtagagacagggttttaccatgttggccaggctggtctcaaactcctgacctcaggtgatccacccacctcggccccccaaagtgctgggattaccggcatgagccaccgcacccagccaccacgtactttttaaactattgtttctagtcttcacagcatccttgcttaagcaggtgagcttggtaacaccaagtgacttgtcaaaggtcacggagccagtaagtggaacaaccagggtttcagagctttttctgctactctagtagttcttacctgaagattgatggtaactcttaattttgcatgtgtatttttcctggtgggagatccatagctttcactaaattatcctagagtaagtgatcccaaaatggtgatggccatcatgtgtaccatgctacctttccagagccccatttctttgtggttccatgtgatggaaaataagctcaaccggcctgtcaggcgaggaagaggcaggtgtatgcccacaacatgcccacagcttggagatcaggtgacctcaaggaggaagtagcccacaaatcacccctcttttcctcttcacagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaaggtgaggccaggacatggttatcccagggaaggggatataacatgtctactgggagcgtttccagattgggacccaaatgcaagaatgatttcctgagaagcaggcttcaatcccacaacttaaatgccatcttcaccatggaagcacagatggcatcagataaggagtcccgttggactccaggataattccaccaagagatttccagcccaggatcctgctgccctgctgtggctggctgtctccatcaccccagtccttttggaccacatcctgaggagcagcagcagcaaaccaaggcagagcagtggaagcggttctgaccattatcactgctatcctttaaaatctctggcttagaggccgggcgcggtggctcacacctataatcccagcactttgggaggcggatcacgaggtcaggagttcaagaccagcctggccaatacggtgaaactccgtctctactaaaaatacaaaaaatagctaggcatggtggtgcgcgcctgtagtcccagctactcaggaggctgaggcagaagaatcgcttgaaccccggaggtggaggttgcggtgagccaagatcatgccactgcactccagcttgggcgacagagcaagacaccatcttaaaaaaaaaaaaaaaactggcttagaatgacagtaagaagccagccaatctttagttggctttactatctgttttctggaaaatgtaaccctgcccccttacggcctgcatccaggtgggcccctcacacacccccgccttggtacaccaccaagggacactgtagcctccacaatctactctcatcttggcaggaagaaaaggcttcaggctcctccgctgtccccagttagatccatgtgtaatcttattcctcattctttctccagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccaggtactgggagtgtcctccttttccccacctccacactagggctcatggctctcctgccccagctcatctatggccttgttctgctgcccatccactttgttcgcagccctggcttcatgctcctgcctctgctcctgactattttcccaaggcggcagctgccacagcttctaccacacatcccctgagacttcattatactccagcctccagggtgtcaggcaatgtgcttaaggctggagatcacagatgaataattcctgatcatgccctccaggagcttagtccagtaatagagacaagactaagtagacagagaagatggcatttgagccaagttaactagcttagagggaagggaacactcaagatagaaacaatagcatatatgaaagccaaatcataaaacagcctaaagagaatttggagaattgcaagtaattcagcacagctagagcttagggtatatgggaaaaagggaaagtggctctgaagcttcggaggtaattctatttattgagcatttacatgaatcaagcagtgtagaaagcacttaaatgtatgatttcatggatcatgactcccattttacaggtgagtaaactggcacttgcagatgtcaatgaatttgcccaaggtcacctatcaatcaatggtaaagagagaatgtgaaaaacaggcaaccggattccccttacgggcttaattaaaccctgtagatctcactgggccttcaagctggaacttcctgagagccatagcatgctgttgaaaggttttatttatttatttatttatttatttatttatttattttattttattttactttttttcgatacagaatcttgctctgttccccaggctggagtgcagtggtatgatctcagctcactgcaacctccatatcctgggttcaagccatcctcttgcctcagcctcccgagtagctgggattacaggcgcgcaccaccacgcctggctaattttgcgtttttagtagagatggggtttcgccatgatggccaggctggtctcaaactcctgacctcaggtgatctgtccgcctcggcttcccaaagtgctgggattacagatatgagccaccgcaccctgcctgtcgagaggttttaagcaggaaagggacaggaaagaacccgcaacttgaagtggaaacatccaggagcactgggcattatttggttgctcattagactgtgaacttccccaaaactgaggtttcacttcagctcacatcattccccaactatttacaaaatcccagttaactggtggttttttgttttgctttgttttattttgttttgttttgagatagggtctcactctgtcgcccaggctggagtgcagtggcacgatctcagctcactgcaaactctgcctcccaggctcaagtgattctcccacctcagcctcccaagtacctgggaccacaggcgcacaccaacatgcccagttaattttttgtattttttgtacagacagggtttcaccatgttgcccaggctggtctcgaactcctgacctcaggtgatccacctacctcagcctcccaaagttctgggattacaggcatgagccactgtgtccaggcaagttaagtgctaacaaataaacccacctaaatctcacttgcaaagcaatttttaaaaccttgtccttaggtgggaagaggtagagaattctgtgtggagtaactcacaagtatccagcaaccttgaataagaacaaatgctgctgagtgccttgttccaggctcctcaaccagggactcacacacacaatccttagctcctcctccctggggtggacactgcaggtgagggctcagctcatgattcctgcgcacgatgatccccgcccacgttgctctcacctacagagcggagaacagccttgggagtcatctttgccagcagtctcttccttcttgcactgatgttcctggggcttcagagacggcaaggtaagagcctgggtgcccttggctctggccctggcccacctcacccactctaaccacccccccgcccagaccagggtggaagcccagatgccccaagctccagccacccacccatcacagcctcctgcttttgagtttgccctaaatgaaaatgaaaccagtcgtgttccctcgttttctcctagctacctcactaaagtctgtcactctcctgcctcagagtagaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgtggctccatctcagttgcacctcagctgcaattagggttctgctccctcgggtgactgctgggag

SEQ ID NO: 27 - DNA, 1300 bp, Homo sapiens
ggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccac

SEQ ID NO: 28 - protein, 258 aa, Homo sapiens
MARPHPWWLCVLGTLVGLSATPAPKSCPERHYWAQGKLCCQMCEPGTFLVKDCDQHRKAAQCDPCIPGVSFSPDHHWHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 29 - DNA, 49145 bp, Mus musculus
  misc_feature (1)...(49145): n = A,T,C or G
agcacatcagcacattttgaaatttgtagatcaagaattcgaggttgggtttggagagatggttcagttgctgacagctcttccagaagaccctgttctgattctcagtgcccgcattgggccttatggccaattcctgggtgtttgatgccctcatctgacttccatgggcaccaaacatacacatgatacacaaacaaatatgcagaaacaaaacaaaacaaaaaacacctatacacataaaataaattttaaaaacagaatttgtagttaaggaataaaacatgaaaatagtatcttcatgccaggaatgaaaagttctttcaccaagggtgcagagctcatccaacattatgaaaagttccccaaaagtctgtgtgacagggacaatggcctcttaggtagtgacacccttgtctgactgggaaagcagacacagccctgtcccagcccaccaggatgtttgtctcctggcaggtgcccttgttcaccttgatacttgctataactacttgctaactttaagttacacattaatccacagatcttttccagtaaagagtcacttaatgtttgctctcaggaataaataagcttacaggccatgtctctatacatacaatgtcactaaaggacaagaagcccttttgtacctaaccaagtgatctggatctcatagtccttttttgaatctggagaacagccatttatgcctcaattcacctctgggactacttctgtttgctctctgcctccttcattatccagcaagttgataattcttccacaccttttcatgctatgtgcttgagagccaagttgaggatcataaacatgtacttttgtccctgagaaggaaaagcagacaagagcacagcaattcctgggcaatagtgcccagaggaccattcacatccatcccagccaaccccaggaaatagagttatagatcacatctttgaggcaagcaaggtgaggatccatacccatgagtcctagaccccacagcagggtcctttctattgtaattaaagtgaactcatactaggataagatgtcactgatccaatagaactgttgctttaggaagaggagagacaggtgcacctggagagaacacatacaaaaagaggcagagaccaagtgtgaaactaggaacacagaggcacttggatggtggatggatggagatggagaggcagaaaggacctcctgggagatgtggattttcttgactttcagctttggggctacagaactcacagaacaaatttcgactgtttaaatatcccctactaaatgcatcacttgactgttccagggcattggcatacccagagcctgtgtcctcaaggatataggtctagttagcagagcagagctgcccttgagcagcctagcattgactgcccattctagaaggaaaaaaaaaaaaaacccactgctacaccaaagtagctgtgtcagttccaaagatgtgtagagtttctgtaaataccttggatactctccaaatagtatctgtagacctcttccggctctgcgtggagccaggttcctttttctaaaccagcggatgcaaagctcatcactttgttttaacatgagatgtcagcaaaccacggcctctaccaggagatgtccactacagtcgaaccgctttccttacagctgctctgtgtacattctcccagcattcataacccatggcttgattcctgtgggcactggctctactgggcagcatggcttagtcactgcagactcaattcaagccaggatggcctccagctggccatgaagggcatttcagactcagcacagcttcacacaatgcctgtgctggctgccccgagtccttccccaaaggacagatgacatgacaaacacatcgtcatgggcagagaagaccaaggcctgaccacatggcctgtggatgcccctttcttccagatcacaagggcagagctgagcacagctgccagccttcccttcctggacagagggagatctctgggccagagcctggatgtattctttgtaattctgtcctgtattcctgttatgcaaactgtagataaaaagctggcttttagtccattggtctattcaaggaaaccttcacctgagctcctgtcccacagactcacaagtgaccttgatcaccaggttagagctcagaatccctactctgtaatgctttcatcaaaaaagcctccaaatctcaccatgggagcaacatggcacacctgatcttttccacaagtgatcttctttcctacatggtgagtcttcaaagacctctgaggtccactgcaacaggagagtggtgcagtctctaccaggtgcagtctctaccaggtgcactctctaccaggtgcagtcttcaccaggtgcactctctaccaggtgtgctctctaccaggtgcactctctaccaggtgtactctctaccaggtgcagtctccaccaggtgcagtcttcaccaggtgcagtttccaccaggtgcagtctctaccaggtgcagtctctaccaggtgcactctctaccagatgcagtctccaccagggtgcactctctaccaggtgcagtctccaccaggtgcagtctctcccaggtgcagtctccaccatctccagctctccatcattgctaggcctcttcagcccaagaccagacacaccagccacctcagccctagagagctgtgggcatctatctcccttgagtttctgtgggatacttggggctgaggtcctctctgcttctattgtgactaacatgccctcgtttctctcaatatctctttctgcaggaaacatcaaagcttactgctgagctgcctgggtctttttaaatcatgctcattaaaatgaaatacttggtcattataaaaagaattcagatgaaagcatgagaaatgtcataaaaatccagtttcttctccctggtaatgtgggtgcaagaggtcttattagctctgtgagtgtatgggagtcagagctctactccccaaaggaccagcagagacaacttgtttctgccccttgcctgtggggccacacacaaagctccttccatatccacaggggttacttttcctgtactgggcccctgcctcgagagcaggtacactagtctgaaccctcccttgctctcagctgtaaccagtgcttctgtgttggaggtacagccctggctaagtctctcaggcagctctgggaggcacgcctcactttgaggaacttcaacagggtatgctgtgtctcacctagactgagcctctccctgcctactgctgtccacccatctgcctttggctaagagttctgcctgctgctctgccttggccccagccagtctgtgtttgaattatgttcctctgctgaggctacctaaggcacaattattttcataaatcctctccccagatcacctctggcctctatttacaatattttgatgaagtgaccagcgcaaggagaaaccgtttattacgaccacattcactgactccattcttccaaactctgtagaaaaggagaccttggcctttattctttacatatttgcctcatccttggccagggctccagacttgatagtccttagaggaggcccaccctcctctaacctctgagacacagagctcctggggttcctgctttcttagtatgcttggaccgctgatgcaaattatcacagaccacatggctcaaatgtcacttctcatggtgcttgggccttgaagtccaagaccaaaatgtcaggagattgggtctggaggcttcctagaacatctgggtctgggttaagaggctacctggttcagagtgggaactttttggtatgtcctcacatgatgggaggaagtttcaagtttcctgtctcctcttctatgacatcgaccccaccagggactctaccctcatgacttacacttaccccaacttgttaccctggtggctccaccaattggcaccatcggtatgggtaacaactgaatataagcatttatttgaagaacacatgtattcattgcacagcattattttgatgttattttgatgctattcaataaggacattttcctggacagaccagttatcctggttatcatatctcccaatagagagctgctggtccttttctagccggaaggcaatctagcgttgggacccaactatgctgatggtgaagagtcctagctgcagcaggactggtgggcataatgtctcccatcactgtacatcaaggagttcatgtttgccatctcctctaattatcagactgaaacctaagcaaggacatgccttacaactttcttcatataaggaaatttgggtatgaatagggaaaatggcttttaaaagtctaaaacagttcctactagagccaggacacccccacctccatctcagtcgtcaagcacacaaatgattatagcctaatcattacttgcacacaagcagacagagggaagtggaagattccctcccagctgggaataagccttgtgaagtggaagtttctggttgtgtcacatgatgcagactcatgtggtgttttgctgaggcaagacccatgggaggacatgtggtgtttggagaaaatataagtaggactcaacggatggtgacacagtgacagggcacttccatagctagctttgcaatgcttcatcggtctctcatctttgcttatcttcactgcttcactgagaatcatggcagagaactcctggtgtcctggctgattcaacggaggcctggcagtttctgctggatcgtgccacagctgctgattgtgttcagtatcctaacactactgaactggactgctggtatcctgacaaacagagattggaatcacccccaaaaaaccaacaggtccatacccccttgtcctattaaccatcatttctcccctacctttggatggtgggctagaaagcatttgggaacccttattaaaagtaggttttaaaaatatctaagcctgcagccctgtggctctgctttgcaccttaagaaacctattagttaaggacctgtcgagatggttcagcagttaagagcactgtctgctctttctgagaacccaggtccagttcccaatacccacatggtggtttataactgtctgtaattccagttcccaaagatctaatgctctcttctggcctccctgggcaccagacatgcatgtgatatgcagatacacaagcagacaaaacacccatgcacataaaaataaaatgaaattatattttaaaatcactttttaaattctactgattagtaaaacactaaattaatttttatactaggctgagaaaactggctgggaaatgtttttcattaaaacatgacatggggcggaggggctcagaggttaagggttcaagacctctgctcttccagaggtcctgagttcaattcccagaaaccacatgatggctcacaaccatctgtaatgggatcccatgccctcttctggtgtgtctgaagacagtgtacttacataaaataaataaataaaacccatgacgggggatttttgcctctagacaagagataatatcagggtctagagctgcctttaagtaattaacaatagacagtcacaggaaaggaccacggttcaattccctgcagtctcacgacagctcacaggcatctttagctccagcttctagacgtctcagtagctggcgtccatggccaccaagcacacaagcagtgtacataaacacatgcaggcaaaatactcacatacataaaaattaattctttaaaatccatgctaggcatggtggcacacacctgtagtgccagaactggagcaacaaaggaggaccagggggttaggtctggagaaacagctcagcaaagcgttagctgggcaagcatgaagacttgagtttgatcccccaaccccgttaaaaagtggggcttgtttatttgttgttttgtattcttaatccaggcatggagtcaaatgcttttaattccagctctagagacgtagagataggaagatctctggggcttgcaaaccagctcagctattggaaaataaaagacccagtctcaacaagttacaagttagacctctcctgaagaggttgacttctggcttatacacacacacacacacacacacaagacagggtggaggtttttgaggtcagcctgaactgcataataaaaccctgtactaggactaaaacccactgaaacaggatgaaacacccaggaacaagtcttgctgaatacgcgccacttctgacaatgagcactatgaaatgttgctgggataataataatatattaataataatgtaataaatatatgatgctgaccatatctacagatcaggagatgggagactgaaaaatgttttctctccagaaacaatttatagattcaatgtaatcctaattaaaattcagcatatctttttaggagagctgttctaaaaattcatatgcaaatgagaaaacagactaaaccaacagttttaaggaaggagggaacatttaaatattcatactacctggcttcaattattatcataaagaagtgtggtattagtcaactgtgnnnnnnnnnnnnnnnnnnnntgtgtgcgccgtcagtgcagacctggcgcctcgcttgtgaagtggcagctgaggagactggtgctcaccatggctgaccaggaacttgaggaaagaatcggatttgatcgacaagcagtcaatgaaatggacacacctgcacagttggaaatggcggtgaagatatgattggtgtgtttcagcagcagacaggaggcctctactaaacagggaacctgctacttcctccagaattttgttatagaccaaatgccacaggagccacgggagccacgggagccacgggagccacgggagccacgggagccacgggagccacgggagccacaggaactctcactctcaactagaaagctgagatttggttctgccacatcctggctactacagtacagctttctttattccttcatttccctgtcctcatttctttattgcacataaagtaactggtgtgtgtgcacaagtatattgcttttttttttcttttttaaactaagtggccaatgttgttttggttgacatcagatggggctggtctggggtcggtactgggtctgtaaaaacattccccctttctccattagtggctccctcattccactccttgtgttgcagtaagttattttcttctcatcgttttgacaaaagaacccaacaacataaaatccattcataccttgtttgatgggagaattttaatgtttttacatctaccattgtaaagccaagtacacttttataacttttttgtacattattgttacaagcagggcaatttgtctttaagtaggggtaaattactcttggacaaaatcatcccttcaagtcaatcctcttgtttaaataaagtttttattaaagtaaaaagaaagttcaagagaaatgaaaccatattggcacgtgataatttatgcataaatggcccataagtgttcacagtctattgtctgatttaagaaaataagacaacttgggctagagagatggtttagtggttaagagcaccaactgatcttccagatcacaaccatctgtaatgggatccgatgccctcttctggtgtgtctgaatacagctatagtgtactcatacacataaaataaagaaataaatctttttttaaaaaacctctaatgttcatcaataagtatatccataaaactgaatatagtgagcaaaaatgaaaatatgctggttgaaaaggccaagcaaaaaatgtggttaatatagatttatgtaatgctagaaattatgagttaatctgtagtagcagaagctgttttctagactatgggaacacaggggatgggagggacattgggaaggaagaattagcaaaggggacaggcactctttggatcctgctgtgtcatcttgctacacaggtaaacacctgggcctcaggtacatcaaaagctatcttatagacacaacttaaaggcatttccatatatcgataaggctatcgaaccccaaacagaaaccaaactgaatgttggtttgtttccaggacaactcattttaaagaagaacaagagcaatctcagttcaagtgtattgcacagagaagtggccttggggactgtgcagaactggttccatccagacacaatgcttccacccaatctccacagcccacctgagcttattcctgacaagagaagcaaccagctttcctttctgtagccagatcattcgcaacaccccagatggctccaacctcctgccctgtggggctgagcctcaccatttccattgcagggcacttcaaatgtgaaatatttacccgggtcgtttcttacaggtttcccatggctgccttggaaagggaattgtttgtttgtttgtttgtttgtttcatttgttttgtttgttgtttgtttgtgttgatgactcggttgagtgccctccatccagccttccacttccctccacatttgcttcctctttgctctgttttctaagccaaatccaggaggatgctctctcttcattaaaccaacggtctgtataatgtgaggcatctttactgggatgcccagcagaaagaatgcactgggaatgtaggggagactgaggtcaaggctaaaggaagccaaaagatctggataactccatcgagctgaggtggtgctgggtcctggttgtctgagtcacgaccacaccatagaagccagagaagctgtctctcatggggggaggggggaggaagggattcaagtaactagaaaaatcaaatcatctttcctccaaccttccacaggtgtacaggcagcagcaactgcagacatgcaaaccacctgacctccacccatgcccgttcctcagaaccttcagaaatggcggacctctacttggcttggaatgagtgttcgtgaataaccaacaccacttttgaaaacagtgttccttcttaagaaagagcagaaaattaatacggcaaatattcattccaagcacatggtgtctgtaggcctggggcagccttaggaaattcggggtgctctctggcttctgaagttcttggcttggtttcctgggagtgccgtgattctggtctggaagcaggcacagcttatccaatttttaattccctttcaagatgattcccatggcagtcatttctctgaaattaagatatttgttagccccaccttcaaacggatgaccttaaagaagaattccaccagtattgaccttgtgtgctcccaagaatctgggttgcattcacccagaaaagagggggagggtgactccttatccttttctatcaaaatgctgaggtaaggatgtctcaggaacatctaccctattgggttttggcaggctgctgcatatctgcattctgtgattggtctgcaaggtgtgtgtgtgtgtgtgtgtgtgtgtgtgtgtgtgtgcatctatgaccttgcaaagtgccctgagacaagagccagaaagctttggtactggaaaatacacaatgctgctttcagcctgtggtgtggaaatcagatttcagagggaataacatcttgcaccgtggacctccacgccactgggtgtggccacagttattgtttccttagtggatgttgcatctctttagaaaatgtgcccaagaatgaagattccgaaaacgatgtctgcagaggaggatagaaaacggtcaaattgtacctgggcagatgcccagatacaattctcctttcattttaccgcattctagcagtgaaattttgaggatactggagtcgaaccagtcagcctgccttgcctcacccagctcggccccgcccccaaaggccccgccctactcacactaggccccacccccacccgccctaagccccgccctcacccgctgcctccttcacggcccagaaccgcagcgagcgccgggtgcggcgctgccgccgcagggatgtgaccttcaccgtcgcttagccaggatgaccggagcccgtgtctcgcggcgtccgcgcctcgcttcagcctcccgggtgctctgaccgcacgctcccggctgctaggctccccggcaccggcctcgccatgccgccaccgcccgggcccgccgccgccctgggcactgcgcttctgctgctcctgctggcttccgagtcttctcacagtgagtaccgcaggggtcccccaaacccactaccccgtggtgtggggctccaggcctgtaccccggcgcagcatcctggtgccgggtaccccagacaccctggcatcctgtccccggacctctgagctctaggcatcacggacccggagcatcccagacacacaggcattacgatccccagcatcccagaccccctacattccagccccgagtgggtgtaggttgaccgtacacccttctttctgcagctgtgctgttgcgggcgcgtgaggcggcgcagtttctgcggcccaggcagcgccgcgcctaccaagtcttcgaggaggccaagcagggccacctggaacgggagtgcgtggaggaggtgtgcagcaaagaggaggccagagaggtgttcgagaacgaccccgagacggtgagcgtgcgccaggggtcgcggggtgggtcctgggcgtcccagaacccatacttttgggggccgcaagttccgactcccaccctgtgagggtccaggagacccggggactgtcgaatcccaaacatcctttctggagatgtaaggatccttgtgtggaccgcaccaccacgtgcaccccagaactcttagacactgagccttcttcgcacccccttgcacttctccattcttgagcccaagtttctcagttgacccacaagtcctctcctcttcaggagtagaaagcgtatccttgagtgggctccactgagatcccttcagtagactctgaaactaaatcttcccctaccctcgaaaagaaagtacccgtgggaaaaatccgcagtgatttgaaactcaaaggcttcctaagactgccagtccctttattggattggaggtgaggggtggggctcctctttggtcttcctccggagggacccagggttttcctgaaagaggaattgaaagatctcaaagctggaattgcttgctgcagcaggtccaaaaatacgatggctggaattgtgctaagaacatgcatacgggcgggtggggagcaacgtgaggaagagggccggcacctgcctctgcaagggctgtgctggcccaggacaaacttctattaataatgtccttggggaatggagcaggcgtacagccaactgcagccagcagcctatgtatgcacaggactctccccagaaggtgcgcgtgggggctgagtggattcatgaggggaacacaccccagcgtagggcatgcgtgaggttgattgagatctggactggcccacgggtctccgtagtgatgcagagccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccacctcccaccctcccctcaccatggtgctgccccaggcatctacagcaggatggggcagatggctgatctttttctacccttgctgctgcttctctgttttgatgattgctctcgacccaatgagttctgccatcggcattctagggtaagtcccagtccttggtcacctgggctgtgggcttaggtgactggttctgtgtgttacaactccaccctcccatgaagcttcctgccattcagtgtggacagggcttgtggtgacaagagttgagagagagcagcaaggccaccacccagcggtggagtcccgcccctctgcagcctgcctgccagggcagacaggcccaagctggccctcctgactgcctggacagggaactgcttttcttagttagagtcaagtccctctggttttaattgcttgtatgttttaattatgatcttatttgcaaaggtctgaaatgaagacatgaaagagagtaatgtcctcaggacccccacctcctccaaataacttctcttcggccatgggagggtttcccttttctgtcagcttttgggtgaaactcctgactataatgctccaaaggacagacccctctggtcctgtcagagcctgtctccttcagggcttggcgtacacctcttcccatcagcgctatctaaaactgtccctctgtaacccctacaccctaacacgtggactttcctctcatgagccagcttggatacctgacctgtgcctcttgcctgcagtatggaaactgttaaccccggcatccagtccgcacgcacctcacgtcaccttgcagagttccaaatcaaagctctttcctagctgctagcaccttgatctggctgctagtcgcttttctcctggcgccacagataccgggcaagcctcaggaagaggtagtaccaagctgtgctctggagtccccgtgatcctctgcagggacccatggctggagcctcccctactccatacccctggggagacctaagacccgcgccagtggatatacaagcgccagtcaccttcatagcctcagaaggaagagtgggaagagatgtaaccttcctgtgaaaatgctaggtcagctttcctggccttgaaatgtagctcattgtaagatgaggcccatgagatggtcttgacaagaggcgtggcttcggtttacctgccccactctttgtgacaatgagaagctgaggtctgcagatcacctaccagagcagattctcacaatggtcctcgggaatccttactgggctgatctgtgagtgaaattttagggtaaaaggaccacgtctgggaatgccaaagatccaggctgtgctgcctgggtaactctatccatagagactagaagtagtgagaagcagaaggcagagatataatgagtcagtgcacaccgaggaaaggaacaagaggcccagtggcctcacctcagggctgcctttgggacgtggatgtgagctttaaatttaaatagacggattgggcacagtgtctgagatatgctgagctgagcagggcgtgtcaagtgtggtccggctaatgctgcctcagtactggtactacaaagtgattagaaggagtccttattcctcgaggggacaagggcgtcctcaggagtgcaggttccttcataataacagttctcagtgatctctaagactctgttgtccctcgagacccttaacttcccttggggatctgggacaagacagaatgttaacacatccttcctatctgcttatctgtgtggtcaaccctgcagggggacgagatgggtatgcggctccaggcttatgtagccggtgcccgagggattagcatgcctccattgcaaaaaaaaaaaaaaaaaaaaagcaagtgacagactcataatgcaaatagaggtgccaggcttccatccaagtcctcttgtctcctgtgggtctgaatgaggagtcagtgtggttttagtgaaagctctcagtacttgttaaaaccctgttgtgtgttccctgatgttgtggacataccgtgctggagtagaccagccagcctcctgtggctccgagtggtatcctggccaactgtagctgatgcacacctgctccttatatctgctatttccagggcccccagggaggggatgacagtgtggtcctgccctccatactgggtgggcctagatcgctggaaacaggccgactcccacatgatgaaccacatggttgttttgttttgttttgttttgttttctcactttgtctgggaagagtctggctctgtttagttagcatttcttctgacattaggaaaaaaggggccagatctgagccctccagtgggcggatactggtagcttcttcctgactttctctggggaggaaatgcaggatccagacagctactgtgtgcctccacccgcattcctcagtggcggtggcagctcccctgtggtggcagccctggccacgtctaatctctctgtcccttctctccaccacagcctctctgttatctggtttccctttttattgttactgtcccttccgggcacttccttctcactggctgggttccctgtcccagttgctaattccagagaggccctgaggttgtaactctgccccaagtgatcctttctgcagactcttcagtaatatacctaagccttaaggctgctccccagcttaggatgctggcctctagaggttcctaatcaagaagttaatcccagctggagcctctgccccatactttggtacaggaaggaagacctcaggcctggttgctgattctcaccttctttttaaattttaagatgcaagattcatagtgggttggctggctgctgcggggattaatactccggaagctgaatgagagacccccctccgccccctccctccctgactgtgtctcagctttcagtggtggctctaattcattctccctgcctgccccccagacccttctctgctgctactgctgtactctcatgggactttggggcactgttagttctaagggtctgggacctgggtgaccatgtttaaaccatgtctacccactaaggacatttgtcctgacatggtgggttctccaaggacagctcggggaaggccagtgccagggcaggtagaacacctcccatcccatttccttttagaatactagacaagaggaacgaggcccagtgtggggagggaaaaataagaaaggggtgtcttctcaggaaaagagacctgagagttggaatttggactcttggcagagaagggacatcttaggtgaaataccttgcggaggtgtccccagaatttgaaagctctccctcgaaactatgtcttcttgtctgtgcttagaatgttccccaaactcagatgagcagtactgtgtacatcttcaactgtaacgctctgtgtgcagagctggtgaggtagaacatgtgtttccaccaccctgagcatctgacgctcagagttccctgggagtgtgcactccacaaagcctgtctatgaagcagcaaacagctaggtacccatggcctatgagagtcagcagccatagggcagaggcacgggtgtgagcattctgtaagcccgatgctgcctgtggaagagagtttgtggtgggcttgtcatgtatgatgagaagtcaaaactgaggatgctagtaacatgctcccccgactacaaaaaaagccattccactgcctcatttcgctaggcagagatgtcttggcctctaagagtctgagaggacttacagacacaggtgagaatggtgttctgcaggtggcagccgcagtttactgtgcagaataatctagaaccttcccagttgtgtggcatgggctggcagttgggccatcccgtttgcaatcacaggaaatgatgtcagtttacctgcaccctgctttgggctcagatgtttctccgtcttgataatgcgtgcatccagcattgtcctcttgtgtgggttttgtcttttgggacatgagctgccttcagatgtagtctgatcaggcagccatggaagctatccagcttcagcccggctggtgagttcctccaaggaggcctggaagaaggattgatagatagctggaatccaagggcaggatcctgcctggtcctgggcagggggacagggagatcagttctgatctgtcactctcaggcagctgcaaaagacactgggtctttctgagctgggtgttagaattgctacatccttccaggagtcaagttggcttgtgctggcctcaagacagacctacagcagtactactggagtgtggttgatgcttttacctttgacctttccatgtgtgtggctatgaaaggctcttccctaaccatgtaaacaccaaacacacgaactccacctcacgcccgctggctgcatccccacacttgactctgtaacatgaagggcatttggtcatctaagttccttccagatattctttctaaaactgtagaaaagcacaccatcaccccctagtcatggggaccttcctcccacatgctccgcccctgttacctctgctctcacccacgtagcccctcactagtgagagagaggtgagagaacacaaacagggacgtctgtcacattgcaggtgaggtgggcgctctgctgggagtctgcagcattggcctgtttggctgcctgttgcgtatatcatccctgaacaggcctctactcatctggtcactggcctggaatagccagagggcttgtatacactgtacagtgtggggatacagagacaggaaagagctcttgtgaacagatttgtgcctcgactagaaaatgtgtttttccaagatattgtatgaaaatcaatgactggggggggggcatctgaggatgaagagaactgtgctagatagttctatgtcaacttgactcagctagaatcatctcagagaagggaccctcaattaagaaaatgcctccataagatctggcaagcttgtagggccttttcttaattagtgattgatatgggagggctcagccagtcaccctgagttctataagaaagcaggcagagtaaggcacaaggagcaagccagtaagcagcatccttccatggcctccacgttagttcctgcctccagctcctgccctgtttgagtctcggtcctagtttccttcaatggtagattatgatgtagaagtgtaagccaaataaactctttcctccccaagttgcttttggtcatggcttttcatcacagcgacagaaaccctgactaagacaaattggtaccaggatagtgggatattgcattgacagacctgactgtgtgttttggggaggagtgtggaaggactttgggctagaaaagccattgagtgttgaggctcagtgagctgttctgtgggagcttggaagatcatactgttgagcacagtggagacaacttgtgaagtttcagggggaaggttaaaggctccactggggcctcttgttattttgaattagattctgtggttctggttagctgaagagatactgatgtgaaacctttgctttgctgggatactctcttgatgctggtcagctggtgctgagaaattaacagtgattgagcagagaccagcatcactgaggtgaaatcttctggaaagtgtttcctgagagtcaacacacagaagctctgttccagagctgtgccttgtgctggcaggagacctcggtagtgtaagaggcaatgggtggcgctggtgttgaatgtgtgacagggacatggagagcagctgaggcttgacaatgtgtagtagagttggcgtttctgaagagagcacaggagaggctattggagataatgcagcccactgcagagacccagcatttgggagatcagtaccatgggatgaccaccaagaacagcagcatcggcggagtgcagccagctggagcctagacaatctaatctgtaagtgctgcaaagggcagagccagagaagtgacctaagcccctaggagaagcccacagctgaaaaaaaatttcaaacatttttggattttgaagagtctgggtattttaaagggactgaacttgtaatatctttgaatttataactactgtgggactttttaaagttatttatgtttttaatgtgagatcatggggatgaatgagagagaaagggttgggacttaaagtgatgtgtgtgtgtcagtttgacaaggggttttatgtcaagttgacacacactaacgccatctgagaggagagaacctcaattaagaaaacgcctccataagcagggctgtagacgagcctgtagcacgttttcttaattagtgatccaagatggagggcccagcccattgtaggtggtgccacccctgggctggaggttctgggtgctgtacgaaagtaggttgagcaagccagaagaagcaaattagcaaacaccccaccgtagcctctgcatcagcttctgcctcaggttcctgtcctgtttgagttcctgtccatggcgtgtaagccaaaaaatccctttccttcccaacttgcttttggtcatggtgttttatcacagcaatggaaaccctgagacaagaactctctctccttggactgaaactgggctcctacctggactgtgtctatcctacaagcattttcccagaagacatgtggagagtcaccctctatttaggtctaggtgacaccgatttgcctcctcctgaaggtgactacacagtcatgctttgcagtcatcttgcagaggctgagtcagcagaggcctctggttcctctgcttctttccgtgacatcctttctggacagtggcttccaagccctacctttgagggagccacagtgcaagattcgtgcttctgggttcctgtctccgggcttgatgagccagtaatagcccttttcaaaggcctcatgctgtgctggttaactgtgtcctttcttctctttccacaggagtatttctatccacgatatcaaggtgagttaaagttactatagtagcttcgttgtcatacacacatatttcatgctggggaaatcccattaccatgttacttctagaagaagggagctgtgagattagagctgtcaacaatactcatgtgtgagtattatacatgaatgtgttttttataccatcattttattctgagttgcctgagcctcagactaatgctgctgttttgcagatatcttcagttgatcgcaggccctgcccacatctggaagtatggctaattgagtgctctccaacttactggtgtcaggactttgtacttctgagattattgaggaccccacacacacacaccaaaaaaaaaaatagttttgcttgtatgttgtgtgtttatcaacatttgctctattatcagttaaaacttagagctttacagaaggctttgtacatagtttgatgaacaggaacacacacataactctcagccactggaacaagcacacagtgacaaggaaaatatcataagttcttttgtttgtttatttccctctgtggtttctctgtgtagccctggctgtcctggaactcattctgtagaccaggctggcctcaaactcaacaatccacctgcctctgcctctagactgctggaattaaaggcatatactagcactaccctgctccaatatgcttttataggagagacaaaaaaaaagattagggtcctagtttagaggatagtcaccttgcttctttaagaagccctatattcccctctgagcactgtttgtctggtgaacacctgaagtactttggatctatattgcttgtaagaactgtatattcttggactttggagtttttaccacacatttgggaaagatactgaccttctgttccacaggcacctgcttataaatcctatctggcaacagcacaggagaccagtgactagcctgctgtgactctccaggcttgggtaccacaatattggctagaggagacaagagaataaagaaatgacagacatatacagtcaagctgggattcatggggttctccaagacatagactatgacccagcacttcaatctatttattagctaaaacgcaggggaagggctagctaatctcagtaggaagtctctgtagatatcaggctgtagacatgagaggaagagaccacagtcgctagtctttatacacactgatccatcatttgtaaacactcgttttcagaatcccaagaaagctttgccattcctcttgatcctggcccgtgggggtaatggctttaccaatttcccatgggtcagttggcgttgtagtcttcagcgaattgtgcccatgtcacaatacacatttactcagggtgtcctctgaagccccacaccagcccaagagccttgggccatctctctgttaacctacacatgcatcctaactgtgcttatgttgtccatgctgccttcccacatgtggcctactgaaggaccagatagagtggctgagcacacacggccatcacgtgttgtatctgttccaatgtcaatctcctggctccccttgaagaacacacttgtgtgccagatctagtgccctccaggcttaaggtgccttaagagtgtttctgcctgcagactaagaacagtacccttagttctgcctgaaccatcgtgatcttgaagctcagctttggccctaatcacacttgcactgtagcttttgctggtctatatggtgggagattccagcactcaccggtctgggcccggtgttcggtcacactggtacaccttcctgctgtccctgccaggcactccgtactgacagattggcatgcactcactggagatccacggtgtccgcatgaaaagaaactgtcatctggccccaatttggataactgctccaccccaggaatgaagagtgactgtgttgtctgtttcttgcagagtgcatgagaaaatatggcaggcctgaagaaaaaaacccagatttcgccaaatgtgttcagagtaagtgtgccctcctgcttcacctgaagcatgtgctgggtagccaggggtaaggctgctgagggagaagctgtccgaccctccccagtcagcttcttgcccttttaactttctttttaacaaagtgcatctcggttttgtttctaatgaacaatacatgtacacattatagagagttaaatagtccgtggggtgtgaggtatgtcccctactacacatcatgtgggcaaaaccctctttcagctctctgcctgcacccggaaatgcagacatggcttttgcacaccggtgtcaccctgtccttagtcaccctgataggagtcccttcccaggcaagtacagtcacatctcctgtcagatgtcagcttctttggctcagcttaaagcaagttgattgaccagcgttggggatttgttcctgttatcacaagctagaatgatgtcctatgcttctgtccacagttctggttcctaagaaagggtcagagacaatttttttaattaatgagtttatttatttacttatgcactttacatcgggctcacggcccttctcccagtaagcccgccccacaacccttcctccacccaaggacgatcatttctttccttatactttctaatttgttggtacatatgaaattattgtccccaggcattcacctttgcccccagtgctctgagggattattctattgctttggttggtggctagaattatggcttcgaaccctcttaagatgttttggattgcagtgacaccttccggtgggaggggcacatgatgttctgctccttaggtggtaggtggcctggaagaggagaatgggcgtgtacttccagagcctgtccctgagctgaacagagaagaaaacctctgtgtctgctggtgacagatatgttaaattcatttgccagatgccttgctggattagggctaacacaaaactgcctcctgcctggctctgctcgtcacaggtcccatgggtgcccacctcagctgtcattgtctgtgcccctcctgaaggctgtgcaaaagtgcccaatgacccgcatatcctcttgctgaggcatgggaagataaggccaaggccaagcctaccagctctgcaggctgcttctctttgtacctggctcctcaccctgctgcccatggcatgtcatagcctgagttctctggttacccattttctgttaaaaattaaagcaaaagtttttgcaggccatcattctggcaatttctagagagctcagacctagccctaaacaaaccctggcctgagcaggtcttctggaaacccattacctcaccccatgggagctggtcaccatgccaacagcaactagagtgacagagagaagccatagtctaagcatggactctgcccacttggtgccaggaagagcattggctcccattccattcctttctcacaagccattcctggctccctgtcatgtccaatgtgatcctctgacagacaacatcaagcagtggttggtgagtcaagccactgggatttcctaggggtctgggctcctttctgggcccacaacataggacctggattggacaggatgggtacccaggtcctaacttgccacctagtgagccagttcacacttcacactccacctacagccacaaaaaagacccagggtaaactgacaacgtaagaatagcttgcctgtggaaagctaagggggctccctcaaggcctgcaaaacagtgtccactctttcacctttctggaatgtgtctaaggagaaactctgggcacctgccaagggtcaaacatgggacttggtaaattcccaacaggaaaagaaatgacatgtcgtgggtggtatttctctagggacagagggacaaaggttttggtattggctctgtgttgggactctcttaaaaataatattactccattggaagttggcacagcgtcatccctcggcctaaggacagattttgcaatgggtagatgtggctctcttggccaagttaaccaacccttgtgccaaatttaccagtgtaaactttagaaataaatttaggcctccaaccagatacttgagttagccaaacaccacgtcttggcctcaggtgggcttccacaagtccacagcagttgtagaacaacaaggccctccagtcctgacccctcacttacaggccactctgactttatccagccaacacttgcttaaggaaaaatgacattttataataatcttccaacaaccactctgaagaaatcaaaagtcgttgaagactcacaggcacactgttggctgtaatttgtgcaaacccagcagactttggatgtaaacgtggaagggccatggggggaggggggaggggaatcagatcgcacagcttccctgagaagcctagacttgcttcccatgcctgccatgggctcggcacccagcccagctggctcaggacaagtggaggctgccaggaatgaagctgacctgaaaagcctggatgggctcctgcgttgcatctgggaaatccagaggttggcccctgccttatcttacgcctggtgtgcccccgtccctgccaggcagcaagattaccctctctgtctagagtttaggtgtgggaggcacctgtggagaggcccccaggaatggagcaaacatggtgtgggtgacctagaagaccttctagcaccctgctaggatgacctcctggagacagtggccagtgtttccaatccccctctggcttggcccgaaactgctccctgtaactcaagaaggaacaaatgctggcttcagacctatgtcggcagcagataggctagggatgcccaagagccgacaccaagaatcaaagtcagagatgtgaattgtcatgactctcaaaatggctgcctactaccgaaagcagaggaagaccaaggaagcatctcaaggctgcctcctcagagagggacagctcaggcttcctattggtcctaggctctggggacagctcaggcttcctattggtcctcagctctcgggtctcagcttttcgtgcaccacagagggcccacccagcccggaacttcctgttagatacccttagagtgtagcatcacctgcctgtgtgaggcatgagctgatggcaaaaaaatttacaagtacagctatgctccaggagtgctggatcacgtgtgactactgcccttggatgcagctcctgcgatgggggcttgggtggccagctgatgctaaccacactcttgaagacagacaggagggaaatggggttggttaccttcatccagtcagagctcagcatgtgccgtctggaggcagccctattttatatcttctactagtgaaactttagagccagtctttggtctggcaacagataggcatacatacatcaaggagaaggaatcgggcagcatgaagatgcttaccaagtggcataagatctctgggtgaaagaatgccagttcacgtgggtgactagtctggactgattagggctaagaagtggcaccccttgtaagagtgataggagctgatacccccatgtatctagaccctcaagaacagcagttctcaacttgtaggttatgacccctttgaggttggatgatgctctcacaggggtcacctaaaaccatcggaaaacctaagtactcatattcacaacacagcaaaattacagttataaagtagcaatgaaaataatgttatggttggggaggggggtcaccacaacatgaggaactgtattagagggtcacaacattagggaggttgagaaccgctactttagaatgatctagcttgttggtagacaggagaccacccaccccatccaggcagactgtagactccttcaaatggagcagagtgaagggcccagggttcctatcctctgggtcatgcccacatctgttcaacctctgaaagggttctttgagaacaggatataataatggctctctcttcccaaccttggggttgaagcacacgcagagttttcctgcctccacgcaaggcatggtgcaggctgtgtccggaggtctcagccatgttcctaaggtactctgtggagggcggtgacattgaaagatcttttaactgcatgctagaagctaaagactgacgctctatggctcagtcacccctgtgtcttgtttgtctgaccactgcacgcctgacgtgatgccccagtgctgagatcctgtgtgtttggcagtgggctccaccagtgctgtggagagaatgtgcccaagtccttctcggggatcttgaagacccatttcctgggaggcaggagccagcagtctctctttgcatagctcagtagatctgggtggtggtgctggaaccgatcccagggctttaaaagttcctcatatttgtttctgtcccaaggtaggaccctccatcacagctcagccttttttggaacccctgggagcttcactgcccccccccaggctctgaccacccccagctatatgagacggtgaggctttcagagatattctgagtggttttcgtttttgtattctccaactcagacttgcctgaccagtgcaccccaaacccttgtgataagaagggtactcatatctgccaagacctcatgggcaacttcttctgcgtgtgcacagatggctggggaggccggctctgtgacaaaggtgagtccacaccttgccctctctctgccccacctactcctcaccctctacccaagactgggagctcaaccatccctacagtcttttctgtatcagcatccctcttgggacccctttgcaggtccagggtgggctggtgctctgcctgagaacctcctgaattcagcagccctgaggttcatcctctagagctgcaggctcctcaagagttgaggctccagggagctctttgggaaccaggattggagtgaaggaaatagcacatggctcttagcaccccagctgatgggtcccaccttgatctactctggagcaggtgtgaggtattaggtaaagctgcaaacaagatggcagagtctgccaagcttctcactcaacacagccctgcggtgtccacaggtcgtctggatagatctgttcagggtgctagactaggctgtgcattggtctcatgactgctgggcactgattggtgggtccattttgtccttcaccctgtccccttgtgcacctagggacctctagaaccaagtctatggctttccccaccagcagcagcagttcatgtatttaccatgaggccagcagggaagtgcccgggtaggagcccctcactctttcttcatgtccagatgtcaatgagtgtgtccagaagaatgggggctgcagccaggtctgccacaacaaaccaggaagcttccaatgtgcctgccatagtggcttctcgcttgcatcagacggccagacctgccaaggtaaggccctggctgtgcagtgatacctcgcctgacttcctatcctggggaggggtggtgggatgagtgtcctttggagatggtccagtccagcatcatgggcgattccctacatctgagagcaagggcaagagctggagatgcccatccacacttgtgcttccaaggcaccttcccacccacagaacctacagacagcctgtgtagtcacaaggcctagacccctgcatgtgactgcagagacctcgaggggtgacagtccccagtacctctgtgcatctgccatacctcccagctccccttactctactcccaagaacacagaagcagatgggacctccccactgtgtggtcccatttccattcagtccagatcacccagaaaaaccatctcagttgtccatgtttcaaccctgtattgatttaggatctagaggaatgacagtccaacacagatagacccagagtatctgagtcactgaggctcaccaggaccagtgcacagcaacctttgtgggtgttccagatgaatgcctgggtgtgagaggaactcaggatctgaacacagacatcatcagacaaatgacgatttcccaaacccaacgtgggaaagggggaaaggttttatttttatcttccacagagttcacctctgaccatcccaaagattattcttaggaggtgtgattgtaggagaactgtcaatcactgtgtcctcgtaactatgtgtaatatacaggagatgcatctggggaggtataggcctcccctcccatgtcctctccattcaaggaacagaggtcctctcattgtggctctcatccctggccttggccaaggctcatagctcccacactttagtagcaggttgaggacacctgccttgcattgtgaatcctgagcaatgacgtctacagtgtacacaatgtggatgagcagcatgtggtccttgggctcactatcacttgacacccgtggtgaaggcatcgtgccttcctcccgttctctaccctcctgccccagtggctgctgcagctgtccaagaccgacctgtactgccttagcctggctgcctttgcttgcagatatcgatgaatgcacagactcagacacctgtggggacgcgcgatgcaagaacttgccaggctcctactcttgcctctgcgatgagggatatacatacagctccaaggagaagacctgccaaggtacccagggtacttccttctttgatgcttagcctaggacacatgttggtcactgcctgaacgtagaccaccttgcttcattggtggcaatcattggtccagtgttccaggaagtctttgtacacaggagggttgggaaaatgtcagaacctcctaggagagtctgtgtagcttcaatgaagaggacccctaaagtgagccctctgtctcatccccttatctggccctattgtatccatgcatgtatgcacacagaccatgctgtcatgagtgtgtgtgtgttcccatatgaactcaaatgagcacacacccatgtgttgtcagccttctctagcatgcagtagacaaagggaagaccttggtagacttgtgttgcacccacagtggatggagagtaatgtgggcctctgctctcctcccactttggaggttcaccatgtcccaagggcagagactccctccacagtcactcctgtctaggagttgcaggagactccaaaagattccctacaggagctctggagaaaagctgagccctcaaggaagggagcacggagctaagaacttgtggggatcctggctctgtaccactctccacaaccttggtccctccatgtctgggctggtcagtctgagcacagtcctcagacatcttcagttcatttctctctagaaagtagggccctaagagataggcctccatgataacaggataaacagtgatgtctacagagtctctaggaggagtcagggggttgcaccgagtgtttggcgccttcccgtgcctactgtgagtccctttgtcgacagatgtggacgagtgccagcaggatcgctgtgagcagacctgtgtcaactccccaggcagctatacctgccactgtgatgggcgagggggcctaaaactatccccagacatggatacttgtgaggtaggtgaccgtagtgtccactagatggcctcgtgaagcccccagtgcctggctttgaataggaccctttgttattaatgggttatgggaagaaagtttctagagacttggttgactgaaaactcctactagctcctaggaccacacagctagcagagcctcttttgttttgttgatgaaatttccatagcaactccccactctcagccacctggcccactggtgtagatccaaggtgtgatgtgttcataccaggataagcatcatatgcatacacacacacacacacacacacacactgttcagggctctatatcaagtaaactgcagggcagttgttcattgatggcattttctgaacaacaggagcaaggactctgggtaaccaggtaccatgataactctgcaagtcagagagacctatgaagctggagaaccatttttcaactatgagcctgaagtccaaatcgttaagctcagtgtggcagttcagggccattgtgtccctcaggctcctggaagccagctcagcctgctttaattccatcctcgctctggtcagtgggaaagcctacagcagaaagcagggaagactccaaggtcttcgtgttctgttcgctttttaatagtatactaaaaaatgattttattattccctgtgttcctctgtgagcttgtcacatttcataatttaagctccagtagcaaataagaatagatgagacaaaagggtgataatggaaggaagaaatcagaaccctggtccctgcctggaggcaccgacatgagctgggtcatatggactctgtgatttctgggagcgggctagccttgggattctagaaggtcagaggagaccttctagacatccaatgtgacctaggacctcaaaggttacttgaaaggcatccacagggcatccccaccccccaacaccatcctatctcatggcaggacatcttaccatgtgtgcccttcagcatggccaagagcgtgaagtccttgtacctgggccgcatgttcagcgggacccccgtgattagactacgcttcaagaggcttcagcctaccaggtgagaagcgaggcacacgggacagcagagcccaggtaagagagctgatccaggacctcagctccacctctgagagaaccagctccccatgtggaaagcaccacaggggccaaactctacctgggctcagggcccaagcagccctgcaccatctgccttgggcctcagtttgtctcctgggtctgtttccaggctgctggctgaatttgacttccgcacttttgaccctgaaggagtcctcttcttcgctggaggccgttcagacagcacctggattgtcctgggcctaagagctgggcggcttgagctgcagcttcggtacaatggcgttgggcgcatcaccagcagcgggccaaccatcaaccacggcatgtggcaaactgtaagtggaaggccaaggctatccctagcatttggggatgggtgtgacccatgggcggggctcctgctctagttagtccagagcctctgcttcattggctgagtgtgacttactcagaaagggagatatgtcgatgaaatctccatagcaactccctactctcagccacctggcccgctggtgtagacccaaggtatgatgtgttcataccaggatatgcaacatatgcgcacgcgcacatacacacatgccgttcagggctctatatcacgtaaacatgaagctttggcccagaagatactggaataactgcttgaggaaggccaagcattgtaagataccagaggacatagataaccaactcaaaacacccatgggcctgagctggtggggccagactcctccgttcatctgctcataggcaattcttctgccctcagctctgacggctgttcccaccagagctggggtggtgcacacatgcgtgcacgaatgcacacacacacacacacactggaaacacatcctatactccaggcagtaaaacaggcttggaagaaaaacagacatgagttttcctcttagcaatgaagaaaaaatgttccactttgttgacaagtaaggacccctgccgtctctccagtcaccaagtgctgtgtgttcttcttcctggcattgagcaattggtgtctctgcagcagaggaggaaagggtccacaacaaaagaagcttgggggggggggtccctctacacagccctggggacaaccctggagtagaacccagctcccagctgtctgggagcagtcactgtggcatggttctgtctaggtggcagctcacacaccgtcactcatagctcaataatagaatggcccaggaggccaaggtctgccccttccagtgctccctgaccagccattcatagcacactctgcccttctgatagatgggggcagatactaagtacgcccccaccatatcgtatataatttaagttcccacacaggaatcttcacttcaaatctttcctatgtgccaagtttctgaggaatttgcttgattattcaacattactccatcctagacactaaattgttagggggttagaaaacttaaaactacatatgctcttctaactacagcagccgcatgagtattgccactctgtagacagctcatgggctgagcggaggtgaggccagaggtgtttaaggttgggtacctcagggctgagaggatgagctctgcttcagtaagcatcagaaccttgtaagtagcagagatgtcatataagttgaggcaggaggttacataggccacagtcatgtataccatggaggtagacacaccaatgagagagccagagtgaactgacattcaggcctagactgcactgaagaaatattggggtttctgctatagaaatctggaagccagtgaaggctgtgggcgggtgcaggaagtgatagctcttctttagcaataattgtcctagtcccttgggccattatgggcacctagccacagtcacctgtgctggccaggtagaccgacagaccaggtaagcaaaaaggtggggccatgtcctgggtatgggatttacctgacaccttggtagtgagcacagtaaacactcgcttctcatcagaagaagaacaacaacaacacagcatctactatctagacacagtgcacactgggatcaccttgggcacagccaacagtgcctcatccactttgggataaaaatcttccagattgggattctctgcaatgaggggctattcctggatcccagagtcaatgtcactcttgggtggaaatttctcatctgcatgacactgggtgagaggtggccaggagcttcattttctggttctggtcatctagagcctagacagcagaagacccagggctgaatcaaatgcgattcaaatgtcagcttagtactgacataggacacacagcctgtgtccaacccatactgatatccttcccacagcagctgtactggtgagggggtcaaagctgagagacccaagcttgtttaatcagggaattttagcttggtgacaagcctctacaaaagctagggtcataacgcccttgacagtgtagtctgtggcgtaggccgcagggcctgggctgcagctgttggctctgtgaggcttcgctgggctgttatctgacaccgtgtttgtgtcacgtgtgttgagaacagttcaaacatggagctggcattaggttcagtctggctctgacccagcactctgctgccttcaggttcccctttgtagcctggaggttcctcatggacacacaagctaccgagagcagctctctgtgccagtccacagtgtccagggtctcaggtgtgaaggacatcttccttagaagagagactgagtgagcaggtcttatctcactttacccgagaccagttggactgtggttggtaccctgtgcttgtcttagagcagggactgtatagacagccaggctccagtttcttgtgaggcttgtgccccatcagacacgactctcaagttcttttaaaccagaataagcatcaataggacctttctatgacttccttctggaaaaagccgtgtgttgtttaatgccaaaggtattggcgagactagccttcttcacaggatgatcctgcctccactttcagatccctgacctcgtgaggggagagccacagtagtgacttcctctgaggaaagaagggtgtggggataacccaggccacagtctgagaaaggtttagctcctcctggacacaggtgacatggtgtggtcttgtgaggtcagacttcctagaccaaataacttggacattgtttcccctgaggtcaggtacccttggccctgtagacaccagcatggtctcgtgggtcaggctccttaaacacagataacgtgggatgcccggcactgaggtctggtgcacttggtccaggtgatacactctggggccttacagaagtgaccgtccacttgattccctcccaccccgcctgaccccctccagatctccgtggaagagctggaacgtaaccttgtcatcaaggtcaacaaagatgctgtaatgaagatcgcggtagctggggagctgtttcagctggagaggggcctctatcacctgaatctcaccgtgggcggcattcccttcaaggagagtgagctcgtccagccggtaagtccattcccgacacggggcaggatgcagctcaggcttggcagggcctacaggggtttgtttgccctgtggctgagcccaagtcttacaatagcagggttccaccgaatcttcctgctggcagccgttcattggacagcagtaactattgatgtattatgcatcaatcactggccacctctcatgatactcatttaagttttcttctagcttgataacaaccaaaaaaaatttactttgcagtaaagataaaacatgccattttgacaaatggaataataaatgctttggattgctatcattttagcttgctagccatacctagatttctagtatgctctaatgtttggccttttttttttttttttttttttttgccatttttcaaagttctgcttctttctgtcctatgccatgcctggcctttgttcttcatctgtctctgagccccatggtcagaaccctcgtttgggggatgacaacacctgctgcagatggaaacctgcttggtagctcatagtgactcggtcaccaagagagtcccaagggggtaacatccaacacaccgttgcagatctgtgacacgtaagggtggcctgatttgatgatgtaacagtttgcacaccgtaagcatgtggttaagctgggactggcatcccttcccctgggctgacttctctacctatgctttgtcggcccgagtaaggcagaggcaaggtacaatcacaataaaatgcccccgacttacacagtcaggtggcaggtaccttgtccctctgcccacagtgacagacagagcaggtggctgcctcactgttacgtgtgcccctgccctgcatggatataggtgtcctgaaatgttctgaaaactgaagagctctcgtgaaaaactccctaaagttgtgtttacaatatagatgcacacacacacacacataagccagagggccctgcctgtagatcctgtagtgctaggctcgaagcctcttttgctctaatctgccattatagtgtcctagctctggaagccaccaggagtcagtcacctgtctttccagattaaccctcgcctggatgggtgcatgaggagttggaactggctgaacggggaagacagcgccatccaggagacagtcaaggcaaacacaaaaatgcagtgcttctctgtgacagaaaggggctccttcttcccggggaatggatttgctacctacaggctcaactacagtaagtgggtgccgccctacccctatctggggctggccgtggtgggactgctaggcagctgtaggctgaagtataagatccatttaaatgcttcctgtctccgtgagtaccagtgatgaactggttacccacaggctggggcaggcctcagcagggccagcaaagcccagctcccaggacagctgcctggacctcacatgttagccatggaagagaaagtgatggagacacggtccaatagttagaagtggacagtcaaccttggacatgtccaaacgcatgacatgtgcacagaagtgtgccaagccttcgctggccagggacttcatgagggttgtaaatcagaaataagtttagaggaggaaagaagatatagcatgaagacaggaaggaggtcagcctttatcacccttggaaggggcctgcacgggtgctcaggcccacagggagacaaaacagaaagggcctgcaaagtgtatcctgctgtgcttctcaggcatgtggctgaggaggggggatgcatggggcctgccgtgatggaaacgctgtccaccagacctgggcgtgaccaaggaggctcaggcaggtctggtactcagctcgtaggctcctttatgcaagagcccataatttcttaaagtacaatagccattgagggtcatttggagccgcccaacctcaagttctgagagagagtaaggatgcctggtgactcgccaggctgagagaatgcaccagacaggcagggtctggtgtcttgtcaggcgcctaccaggtgagatacacttggcctcttctgtgaggacaaagtgtttttattcttactttttttttcaatctgtgttcatacactcgacaaactattgagaattaatcctgtagatgtcatctagtacagaatagaggacttgatttgaccgtggtgggtggagagatcaagctagctttagcaccctctagtatactacagagggcagtgaggtggaccctgtctctgccaacaaccctgattcacagtggcttcctctattctggagttggtgaggtacagatgtaaatatcaagactaagggttttatgcggcctcctgtaatcaggacttgcgtcacgcagctgcgccagcacccacatgtgttatatgggaatatgttcatgaggctctggaaggctcagccaaggcacccagaccacagatatacatagggcctgctggagcgatgcctcccacagcatctgttctcagtcacccacgagtatgacctcaagttctccagccaacttgcatgctgtagggtctcctggagccagcagaagggaggctagcgcattggctgaggctgtggacagtgctttgagaacagcagggggagacgtgggaatgaggaggcggcagatggccctttctgctgggcttgtagctccctggatgggttgttacccagaggacacttcgaggtgaggagcagccatacttaggcatcccccgtgcccacgggttgatagtctacatacagtgctggagttcttgaccctgttctgcaggctgaggaaataagggttgcagctcagattcacctgactgactcaggagtgctgctagcactggtgggagggacaacgatgtcatccccctctctgtggccctggccgagtaccactcagcagatatgttgacacactggcaggtcttggggtacaacctggttgcatgctccccactcgccttcttaccaggaggtgccctcccagagcgtgcagagctgtcgtcccctgtgatcgctccggtctgggctgccactcactctcgcctctctgccacttggattgccttgtgatgggccgctttcattgcagcccgaacatcgctggatgtcggcacggaaaccacctgggaagttaaagttgtggctcggatccgccctgccacggacacgggggtgctgctggcgnnnnnnnnnnnnnnnnnnnnnntggccctagtcgactaccactctacaaagaagctcaagaagcaggtagaattgaatggggccagctttgactaggacacgctgatcaccgagcaccccatctccaccccctttgacctcggtgaaaacctgagacacacccattcatccctggtaccaagtagcaaggaaaggtccccagcccccacccactctctgggatattgacttgttgaaccctgccctgccctggagactccttcccagacccaggtctgagtgcacacagctaggtgtcccctctggctttggggacatggttgccatgcagtcacatgggcacaactgtacagcatgggctaaggtggctggtggggcagtgagcctctgcggggccgtaagcatggagtgtctcacagggagccgtacatacaagagtcacatcatgtcactagcactaggagatttccatattcttccagagtcagctgcccctcaggcagagctctgcttcaccgcagactatgtccagtgtcccccaagccaggcaactatatcaagcctccgactccaactatttgcttataggaaacgaggctattgagagagaaaggaaaaaccttcctctctcccatgttcctaagaggggtgtgcgtcagacaggagggtttctctttccatctgcccaggccgtagagccctgcttgctacttatactaaccagcaacagggttaatttccatgatgcataccaccaaggggtccaggcttcatgctgcccagcatctcgacccacccctagcatgtgtgatcaacagaccaaggcccttgctagcaaagactgttcaccccagagagggcagtgtgtctgatctttcccagtgctggtaccacagcgctacagctgtatcctgttacatcctttttgagaagtcagctcaggctgggaaagggtaattcaagccctcggttttccagggactgcaaaaggttttgcatgtatgggtgtttggcctgcatggcatgaatgggcaccatgtgcccgtggagaccaggagagggcagcagatcccctggaaccggtgtcagagatggttgtgatccatatggatgatagaagagaactcaagtcctctataagagcagtatgcgctctaaccactgagccatctcctcctgtcaccttctggctgtcccctgctttacattcaaagaaaccaagcccaggggaggagaaagcacaagggttcctagacatcctcagagcaagggttaccagacaccctaagaagggactagtgtacaaagagactagtaagacaggacagctagcctacggggccagcctcgcccaggataggcagacccctctataactcctctgcctctctatcccctgcagttggtggtcctggcagttgaggatgttgccctggcactgatggaaatcaaggtgtgcgacagccaggaacacacggtcactgtctccctgcgggagggtgaggccaccctagaagtggatggcacaaagggccagagtgaagtgagcactgcccagctgcaggagcgactggacacacttaagacacatctgcaaggctctgtgcacacctatgttggaggcctgccaggtaggagcactctgcctgactggcttcacataggggctgtggtgctgactgggagacagggttctgctcacaggaactataaatgcaggttgccctatactagggttagagtgagggggtcttatcagttcagtccttcatctggcagacatagctctaagtcatccattgaagagtgtgtctgagaacccaggagcccaaacacagaggagaaggttaccaggcgatgcaaaatgaggtacctggatactggcaggcatctgtagctttaagtagctggcagtgtaactgcctgcccttcgcacacttctaccagaagctagcaagagcagccaacagcatcctgcttgcttacacaggcccacaggtgggactggaacaggggtagcaggtatgcacaggacttgagttttagcaaacagcagactctctgccccgcctggtaggtatttagttttaaccaatcagaatcaaaggcatggggactcacaatataagatattcatgcatgcctggtgtggggggtcgcggttaagggatgggttaagggatgccgatgatgtcttatgcctctaagatctgtgcccccatgggataataacagaaaggggacacacatcctgcagagtgtgggcaaggctggccctcagctatatggagggtggggagcatcgtgtggtcaggatcaagctcctttggttcagtgtttgccctccccctgctcagaagtatcggtgatttctgcacccgtcactgcgttctaccgcggatgcatgactctggaggtaaacgggaaaatcctggacctggatacggcctcgtacaagcacagtgacatcacctcccactcctgcccgcctgtggagcatgccaccccctagaccgagctgcaagagggctccacacctaaagacaaaaatgaagcagggtttggacacacagcactggctcctctcgcatggtcctgcaacactggagcaggtgggctaccgcccttgtggtttttttttcttgagatctttctttttgccttgtaacatatctgtacataatgggacgggtgtcgggtcaccggctgctcagagagagccacgtgacctggtgggagctggctggaaggggctgggctagaggggctggcagtttgcagcagaacggatgtgaagaaaataattctctattatttttattactacatgcttctttctgactctaaaatatggaaaataaaatatttacagaaacctttttaaccctgtgttggtcactgtctatcctagaagatctgttttgggggtaaatgcattttgagagcatttggggcataggccccacagctggatgtgtctttcctgggaccgccaagtcccagaccaggcagctgtggactacctaggagcctctcctcacatgaatgatggaaagaggtaaagtcagtgttcacagcaaactgcagaccctccatttactctgcaaatggagaccaagttctgcccggctctgttgtcagtcccacatgtagaacccttctgcccctgacaaccagaatgtggggagggcacctgcatagattctccccatctttccctataccagccatttgcctcttggctgctatagggaaagcccctgttccgtctagtttgtttcaaggctatgagcactgccgagagagctaaaccctccccagactacaggacacacaagaacacaatcgctttctcagtgtctccaagttgcagtttttctgaaaagtttggggagactgatttttaaccctagcaccctgtaagctctggtgaagatagggcaggaacaacattgttgagcacagctcccaaaagcacagtcctgcccagaaccctgagcctgtccgtttgtcctcaggcagcctcagaagcctacaaccctctagaggtcagctctgtcttcagctggtgaggccgcatccccctagaccttcaacggttttcccttgcattggaggcaactctggaatgttctcatggaatgttctcacgaatgtcctccaaccacccccaattctctccaggtcatgggggcaagaaagagtaggaggcatgccggtttggaactagaccacacagacatgcagggagcggggcacatacttggcataccttatctgccttggggaggcaccactgtgggaagaacacagacacctctcttctctgatggggcatcctcagcctcggctggcactaagccttataccaaagaaagccataatatgtctgccagctgcctatcactggcatctctcttccctaagttcaggtggccaaactacggagccccaggggggaacatcagaaacctttgaggagagatgatgcagactttgaaagaagagagtagactgaagtgtgtggtctttgtggtctgaattggttacaaatttgtctttttaggaagggcttttatcgtctcctttgagctatattcattgtatccttgaggttgctttcttgggcctggggctctccccatgcacgcaggacctttgtcagcaccccatcctcccctgggctccattacacccctctcacagacactctgataaatatgtctccaatttttttccagatgtacccagggcaaagtcaccttttaggaaccactgctgcagggctgaccattttactgtgttttccaaaacgcacaaaacctgcaggtcatacattgaaacggaaggctaagtgatctcactggaagatactggagacacccaggatcacattgtccagaatagacgatgacttcctacaggtagaggggccaagagagaagcaagtagaggacccaagcaggcccagtagaacagcctcggctgatcagaagggacacgcacacagaggcatgccctcagaccgatgccgtccattgccacactattgctcctgggtcttagcagagctattatggcgaagtgacccaagagaagatagatggtccaagtggaaccccaactccagctgatctggtaaggtgaaagaactcagctcagtgtctttcaccagtggagcatggcccaccccatacttgccccccgctctctcacaagagcaatcagcaggtgccatagcacagacccagaagcaaccccatcttccatcaaaccaaaagcagcagcaactgatagatttggtgacaaaatgagtggccatgagcaaatcttaccacccagagcagaagccaagcacagggcagacccttgagcagtattcgaagaggcaaagccatggagggatgagccactgaacatgcaggctccagctggctttccagcctcgtccacacaaaggcaaggacactgtcggcatatccggccacactgtagattagtgtgggttggggagggctgctctggagactggggtgcagggccttacattctctgtggctggaatgaggaagacagacatatttgtggcaaggagcaagactgttaaccttgggagttcaatgtttcttaatagttcttggctccagtgggcacgggctctatacccagacatgcagttttgttggtctgcaaaggccctagggccagccttatggccttcagaggtcgagtcccttgggcccagggcacaggactactgaatacaaaactagggagatggaatctaaaaagagctagagagagggtgtgagaccctgcaccagggaggcaccgatgccttacagaccctcgctttcagcagcctccagagcttggctcttgtctttacaatcactacacaggtgaggcaaccttcgtcccagtcctggggggagggggggagggaagcagcctactgtgtgtgtcttcatcaaggatacctctctgtacctctggccacccacatcttcctgaacctcaccccacaaggaacaggaatcttgccattgtcgtgtagaatgcgttcgtcctcagccagcactgtagcacgtcccctgtgagagctacttaactgtactccctctggatagatgccaaggcaagggacagagccaactgacccctgaccccgctgaggagccgtgcccgaggcgccctccaaagtccagggatggttttggcctattgccctcaagtgcaactccacggaagctttcacaacagcctctgaaactgtggtcctgggaggtattaaatatcttagtacatacagtggtgtaaatataagttggcagattattatggatatttatccggggtcctagggaggctgaagccaggctcctggagggtgtagggaagcaactgtgctggatccaaggtcagtcatcatcaaacagaaaccaagactctctcatcctcaggctccaaggccaaactcaataagaagggtcgtgcacagttagcagtcctcagaccagtgactgtctcagcacttctgggaccagtgtgcggctcttgggtttgcagcacagcttctgcacagacagacttatcacctctctgcttggaaattgtgttgtgggtcttttgtaggaaactgtttagaaaacctcttctagcctgctttggtaagatcttctgttggacagcgtggacttggccagcagggggcgctggagcaggtcctccaccccaaactgctagttctgtccagccttagagagggaaaggcaggctggtgaggtagccacacaacatctaatcaatgactaaatcagtggccacaaagcaacagcgcattacagggagaagcaagtgtgagatccagagtctaccaaaagggagagcttgcacagaggcagaactcaaaagctagtttccttctcagagacgtgctcacagaagtctgtcaacctgtaacacatgtcctgagggaacaaccctcattgaaagaaatgcctggctaccttctctttgcagggtgatagccatcaccatggtaagggcaaaacggaactctgagcgatggtccatgcagagaagtccttccagatgaggaggctgctggggtctagtacggtttgctgctggtcttcacgtagggagaggcagtgaacagcagaggtggcatggggccagtcggctagctagctctgctcctgcctctggccctgacctgtgctggagagggtgtgcccaagggaaggccaacagctttgcgatccttttggaattctctatgaggctggctgcagaagcgggctttctatatgcggctttattttgttgttatattttgggaaaaacccaaaccacattactttttagtctacgacctcctctgtgtcagggtgcgtaggggggtggcttctcccctgggaggaagtaggctggtgtgcagggtgaaggagcatgggaacacccacggctgggctggcactgggagggagactctgtgtcctcaggcagagagaggtcagcagaggccgaggctggcggggcactggagggctgcaattaaacagagaggcgtcctcgatcagcaggtggggggactcagctacgctgtccagcatatacaccagcaccaccttgacccagcagcttaccagaccaggaggcaccggctcatcgggcctctcagaaggcctctccagtctagaacagccaagagacgtcagatgtcagcctggacagcatctgattgacacagacctggcttctaaagctgttggggacacaggaaggtctccaaactcctggcttggttggcctgcttagcccagtcagctttcactagcactaactagaagatccagggacaactacagccaggacttgacactcactaaagacagcaagaccattaacattcccaacacagcatggtgattattgtggtagcagccaaatgtggtcagccatagtctagaagtttaaggaagttatttttcagatgtaattaatcagtgactttgagtaagctggtaccctactgtcagggcttctagtccaatcagttgcagaccttaagaaaaaaggcagagaccctcaaggaaaaagaaactcttgcccaagtgtgaccatgagttacagtcccaacagtacttccttggtcctgaggtcagtgtaccattggactggagagatggctcagcagttaagagcactggctgctcttccaggggtcctgaattcaattcccagcaaccacatggtggctcacaaccatctgtaatgagatctgaaaccttcttttctcatgcaggtgtacatgcaggcagaatgctgtatacatgataaataaacctttaaaaacaataaagacaaatctctctccacatttgctggggttgtatctctgacatcccaataaacacccccaagatcaaagataagttaatatgagaagaagaattgggggacaggactgctctgaaggaaatcttttctagtattttcttttcccgtcttaagtaccagaagtttaaaacttaaaatcagggtttgaataaagtgagtttgaagtgagtttctaaagtgattcctgtgtgctgtgtagtgctctccctggctgcatcttggtctcatgagcaactagctagctatgttttcctgatactggagtcaggatctgacaacctgtctatcccaaagtcacttcctcccagggaaggaagactggaagctgagaatgtctccctgactggagacaaatgtcacaaaaagttcaccgtcatatctcaaaccttctcatttctccccgagtctgtgtgtgcatccttacgagcacgggagcaatgtattcctagagatcgtcctcttaggtctactaggacgggcttctcacgctgtcccctctgttttctgaaattagtcagatgcacaagccatggagcaagcccttagaaaccacagagcaagccaccaggaaccttagcataaaccaccaggaaccacagagccaaccactgggaaagttggatgaaagcagctcactaaacaaggccccatgaaggcagttcctgcccacacagaggaggccaggattgctgccccagaactgccattcaagctaacctctgctgtcattctgggcaagctgctgggttaggcatggccccaatgtttgcaggctgctaatgacttcaacaggacacttaaaatatctccttcggtctctgttggtctgtagaaacagcattcgttccattgttccgagggaacacatggctcatccgatatgccagtttctacagaaatctgactgctaaacatatatgcaattgtactctcacacttgccaccatgaaaagctgctcagcccagagggcggggtctcggcccagagagctgggtctaagccctcctcttggaggaagggaagcctcctttctgaaaacacaaaggtcccagaaggtaggagacgagcaagtgtccatggaacctggcaggtcatcttctaggttcccaaaagtgtatctgtggtgatggactgtctcttatgtgccaccacagggggtggggggtaatttgtccttttccatgtggaacagggaagaacaccacatggggagtctcacatcccatgagaacaggccggcagctctccacagctgtccattcttccttaggccaggccttcgagactgagaggcaggagggcaccaggacagactccaggcaggaggaaatggaaccacaccttctgcattgttcatcatcccctgtggagcatcaggtattcattctgcctgcaccggctgtgctctggaattgtgttcatggcatctatgggacttcgtgggtctctgtgtccaaaggcaggcagagcagctaagggaaccctatcagggctaccaagagtagcaactaacagtcttgcatgtggatttgacaaaaagccaggagaacagagcagggtttcaggacgagctgcagcccgaggtgagagcatccttcctgaggtggagaccagggagatcctctcaaagccaaaacagaagttccatcaaaaggcagaggccttggagctgcagctgcttctgctggtgccacctgcccttggagtcaccaccaggaccatctccttccctgaccctagacatagctgcctccagtgttccagagaggagagagtcagttccaagccagactttatcccaaaaggccttatgtcccctgattagggggtccctgtggctccagcagatgaaggtccagttcccttttgggaagccccactagcaccacctggggatgtcacactgagaaaccagacccgttccccaacattgcaatgacccactgtagcagcccttctccagagcctaaaggacccaagcagttcagcagttccagccccagcttcgtctctaggcaaccagaggaaactgaggtacagagaaaaggggtggggtgagacagcaatacagtgacctctctgagtctggagcaccagtgatccctggaaaacagaaactacactttaaggtcccagacactgggggttcccacgccttcttccagctctgtatgctgtcagtccccacttcacaaatgtggacccccgatggtcacaagactcccaagtgctgctcacacatggtcacaatgttgggtcagtcctaggactctggcagctctttctatccgagatggtcagaggtagacattcatgtcctccccaaagtgtcattttgcttggcaaggccttgtacttcgtgtcagtatggctcattagacagaggtctcctgggggacatacctgaggacctgtgacttcaaaataaatgatttcatcccatacagcaggcccacaggtcaaagagactcaattcaacatttactcagcacagctctgggcatctcatgactgcctctgctggtgctgtaagacaagccacctaccagccaggctgcaggcccgccaggcagatgagcaggcatcgctccacttagaaaggtctgtctagacctgggatctcagtctccccacaggagacactgggcagcagttacagatgatgcatttgtcacgacgaggggtctcgacaggacatagctaactaaaacacaagccaggaggctctcaaaccccacaagtccacaatggcaggtccaagtcagtacagtacactggacaactggggccatcttacccacggccagcagagcttcacgggacatgaacaagccaaagccaagaatgggaataggagaggcaaagccctattcaaacaggatctcgcagaccacctcccctgaggttcgcagggcccgcagcactgggcacatgagccctatgggatcgacacctttgttggcaagtacctggctccatgtagaacactcactggtgtacaagtattcagaacccaggcatctgttggcgtcttaagtcccccgtaccagtatgatagctaaagtaatcagcttctgaaataactctctcatgagccgtgaacagcaatgagcctcgaaaatggcgtgacccagcccgtaagggtccccttccttccccattactaactatatcaaagtccacccatctctacctgcagccctaccctgcctacctggaagcccacagaaacaacaccaacgtcacagcacacctacctgtagcggcagagggtaggaggaacaggttggcacacccatagacggaggacacaggccggtgtaggcgagaatctgctgtgcagggttatagagaatctgaggtggcggtgacgggccataggccagctgagacagagggacctgtggagagagacaggggcatgaccacctaaccctcacagccactcgagggagtattcagccctgcacctggcctcctgaggaaccctgacccaagccacgaagagtaggcctgtcttctcttcatgacctcacagaaaggcccagcatcctctgcacatgggctctagactggagtcaccacctggagctgccacctgaagaggcagcctgatagagcccagggaccagactgagggaattcgggaggtgccaagacatcccctagcaacaagaaacctgagaaggaagagttgagcagtggttctagggtggtagtgaacagagcaaccaagggccaatgcccctgggaccacaggacaagcaaaacaagaatggcccaggcagtggtttacagccctgtggacttggaaggaaccctaaagggtttcccatgggccctgagaggacaaaggggaggctctaccagtgatgtaaggctagggctcaagggcagatccaatagggctggctcagagagaaggaggtaggggtagatttcgggtttctcattcagcttgttaaaatggggtccaagccctactcagaaccaccccaaccaggcagccatgaaccccacagtgacagagtgacatttttctcttagatggcaacaaggtcttcctgcctaagtgggtgggagaagattcacccagcgggttgtcaggtgctgtatccagaaccagtgattggtggtcctagttgccacctgacgtgcaggtgacttgggagtttggatcctccttcattgagggaaccactgggctctcctgaaggggaaggccctgaactctgggctagggctgaccggctggaaacacacagaagccatcactcaccatgtccttgaaggcccctaggactgcagctgtgacaatgcccaggcacaggcccaatacgttcagcactgtggatacccagagcagccggtacaggtggaccacgtcctggcagctacgcacgcccacaaactcatagtaggcaggcgagggctcagtgctgtaggagggagaatagttactgccctcattgctagaccatggccaggtgacaggacaaaccctggggttcccagtacccgaggccactggctctaatagtgctggtctcctcttacacaggtgaaaatgtcagttagacaagttagagacctctgcttctctatggactggccagggaagctccaccagacctcacagtgaggcatcagatgggcacaggatgtcccaaattactagctctgggcctctaatggccaactgggacagtggctgagttaccctccatgccagaatagtaaccaagcattttttgtgttttcagttctccacgtgtatcccaagctgtaggtggttctctgctctgagaggaatagcccacagctggaatgtgctggctgccacctggtggccaactgtggtcctccctggaccttcaggtacttccatacactgggcacccttggatggaaacccaaccactccgaggacccacccatcattgtgatgctgaaacaagatccagagggaagaagca

SEQ ID NO: 30 - DNA, 2550 bp, Mus musculus
  misc_feature (1)...(2550): n = A,T,C or G
gcagcgagcgccgggtgcggcgctgccgccgcagggatgtgaccttcaccgtcgcttagccaggatgaccggagcccgtgtctcgcggcgtccgcgcctcgcttcagcctcccgggtgctctgaccgcacgctcccggctgctaggctccccggcaccggcctcgccatgccgccaccgcccgggcccgccgccgccctgggcactgcgcttctgctgctcctgctggcttccgagtcttctcacactgtgctgttgcgggcgcgtgaggcggcgcagtttctgcggcccaggcagcgccgcgcctaccaagtcttcgaggaggccaagcagggccacctggaacgggagtgcgtggaggaggtgtgcagcaaagaggaggccagagaggtgttcgagaacgaccccgagacggagtatttctatccacgatatcaagagtgcatgagaaaatatggcaggcctgaagaaaaaaacccagatttcgccaaatgtgttcagaacttgcctgaccagtgcaccccaaacccttgtgataagaagggtactcatatctgccaagacctcatgggcaacttcttctgcgtgtgcacagatggctggggaggccggctctgtgacaaagatgtcaatgagtgtgtccagaagaatgggggctgcagccaggtctgccacaacaaaccaggaagcttccaatgtgcctgccatagtggcttctcgcttgcatcagacggccagacctgccaagatatcgatgaatgcacagactcagacacctgtggggacgcgcgatgcaagaacttgccaggctcctactcttgcctctgcgatgagggatatacatacagctccaaggagaagacctgccaagatgtggacgagtgccagcaggatcgctgtgagcagacctgtgtcaactccccaggcagctatacctgccactgtgatgggcgagggggcctaaaactatccccagacatggatacttgtgaggacatcttaccatgtgtgcccttcagcatggccaagagcgtgaagtccttgtacctgggccgcatgttcagcgggacccccgtgattagactacgcttcaagaggcttcagcctaccaggctgctggctgaatttgacttccgcacttttgaccctgaaggagtcctcttcttcgctggaggccgttcagacagcacctggattgtcctgggcctaagagctgggcggcttgagctgcagcttcggtacaatggcgttgggcgcatcaccagcagcgggccaaccatcaaccacggcatgtggcaaactatctccgtggaagagctggaacgtaaccttgtcatcaaggtcaacaaagatgctgtaatgaagatcgcggtagctggggagctgtttcagctggagaggggcctctatcacctgaatctcaccgtgggcggcattcccttcaaggagagtgagctcgtccagccgattaaccctcgcctggatgggtgcatgaggagttggaactggctgaacggggaagacagcgccatccaggagacagtcaaggcaaacacaaaaatgcagtgcttctctgtgacagaaaggggctccttcttcccggggaatggatttgctacctacaggctcaactacacccgaacatcgctggatgtcggcacggaaaccacctgggaagttaaagttgtggctcggatccgccctgccacggacacgggggtgctgctggcgnnnnnnnnnnnnnnnnnnnnnntggccctagtcgactaccactctacaaagaagctcaagaagcagttggtggtcctggcagttgaggatgttgccctggcactgatggaaatcaaggtgtgcgacagccaggaacacacggtcactgtctccctgcgggagggtgaggccaccctagaagtggatggcacaaagggccagagtgaagtgagcactgcccagctgcaggagcgactggacacacttaagacacatctgcaaggctctgtgcacacctatgttggaggcctgccagaagtatcggtgatttctgcacccgtcactgcgttctaccgcggatgcatgactctggaggtaaacgggaaaatcctggacctggatacggcctcgtacaagcacagtgacatcacctcccactcctgcccgcctgtggagcatgccaccccctagaccgagctgcaagagggctccacacctaaagacaaaaatgaagcagggtttggacacacagcactggctcctctcgcatggtcctgcaacactggagcaggtgggctaccgcccttgtggtttttttttcttgagatctttctttttgccttgtaacatatctgtacataatgggacgggtgtcgggtcaccggctgctcagagagagccacgtgacctggtgggagctggctggaaggggctgggctagaggggctggcagtttgcagcagaacggatgtgaagaaaataattctctattatttttattactacatgcttctttctgactctaaaatatggaaaataaaatatttacagaaaccttttt

SEQ ID NO: 31 - protein, 697 aa, Mus musculus
  VARIANT (1)...(697): Xaa = Any Amino Acid
PEPVSRGVRASLQPPGCSDRTLPAARLPGTGLAMPPPPGPAAALGTALLLLLLASESSHTVLLRAREAAQFLRPRQRRAYQVFEEAKQGHLERECVEEVCSKEEAREVFENDPETEYFYPRYQECMRKYGRPEEKNPDFAKCVQNLPDQCTPNPCDKKGTHICQDLMGNFFCVCTDGWGGRLCDKDVNECVQKNGGCSQVCHNKPGSFQCACHSGFSLASDGQTCQDIDECTDSDTCGDARCKNLPGSYSCLCDEGYTYSSKEKTCQDVDECQQDRCEQTCVNSPGSYTCHCDGRGGLKLSPDMDTCEDILPCVPFSMAKSVKSLYLGRMFSGTPVIRLRFKRLQPTRLLAEFDFRTFDPEGVLFFAGGRSDSTWIVLGLRAGRLELQLRYNGVGRITSSGPTINHGMWQTISVEELERNLVIKVNKDAVMKIAVAGELFQLERGHLNLTVGGIPFKESELVQPINPRLDGCMRSWNWLNGEDSAIQETVKANTKMQCFSVTERGSFFPGNGFAYLNYTRTSLDVGTETTWEVKVVARIRPATDTGVLLAXXXXXXXXALVDYHSTKKLKKQLVVLAVEDVALMEIKVCDSQEHTVTVSLREGEATLEVDGTKGQSEVSTAQLQERLDTLKTHLQGSVHTYVGGLPEVSVISAPVTAFYRGCMTLEVNGKILDLDTASYKHSDITSHSCPPVEHATP

SEQ ID NO: 32 - DNA, 65423 bp, Homo sapiens
  misc_feature (1)...(65423): n = A,T,C or G
ccccgtctctactaaaatacaaaagttagccaggcatggcggcatgtgcctgtaatcccagctactcaggaggccgaggcagaagaattcctagaacccgggaggcggaggttgcagtgagtcgagatcgggccactgcactccagcctgggtgacagagcaagagtctctaaaaaaaaaaaagaaccacctgaaaggagtagagggaccaatcccgcagctctcacaggtccggaatagttcccgtttccatccctcagcgtggaaaatctcattatccacaggacattagggtgagcgctcacaaaggctttgcctggagtggcagcttttgccctgactccctgcggctctggttttgccctaacaatgcctaaaagtaagactttagagataaaaaataaattgtctgagatgaaggatatactggatagaattaacagcagatatgacattgcaaaagaatagggaacttgaaggcatagtaatagaagctaactgaaatcaaacccacgcagagggggaaagactaaacaatgaaaacagaatagccttagtgagctctgggaaaactccaagcagccatctgtatgtatacctggagttccctaaataaggagagcatcttggggacagaaaacaatatttgaggaaataataccccaaaattttccaaatataaaaattagaaacccacaaatccaagaatctcaatgaaccccaagcacaagaaacctgagagaaactacagggtacaatgtgataaagtttcttgaaattagtgataaagagaaaatcttaaaagcagccagaggaaaaagacattatgtacagatgaacaaagaaaagaatgattgccgatttcctgttggagacaatatatgctaaaatacgggagggcaatgtctttgaaattaaaaggcacaggggaaactgtccatctagaattctatttgcagtaaaaaagatccttcaaaaaaatgacttttaaagacatacaaaaactgaaagaatgtgtcaccaacatacatacgctcaagaacattttaaaggtttttactgaggcagacaaaaaaaaaaaaaaaagataccagattgagtctgcatctactcaaagaaatagcagtgctggaaatgataaagatatgagtaaatatttttttctcatcatttaaatattttaaaagcattgtttaaagcaaacaatagtactctgtattgcaaggtttatgacacatatagaagtaaaatgcaagaaaacaacaacataaagagaggagagaaatagaagcagactgctgcaagtgaacaggtgactctaataagttaaagctgtataataaaaatcacacagcaacaccaaaataacacaacaaacaattgcagttaataagccaacaagggagaaaattctatcataaaaaatttggttaatccaaaagaaggcaaaaaataaaataaaataaaggaaaggaaacaacaaatgggagtaatagaaaacaaataacaaggtagtaggtttagaccaaatcattttaataagtatattgaatgaaaatgatctaataacccaattaaaaggtaaatatcagattggatttaaaaaaggaagactcagttacatgctgcctacaggaaacctaccttaaacattaagacaaaaatagaataaaggaaaaagaattttaaaaattatatatatatatatataatgcaaacactaatcaaaagaaagctggcatggttattttaacaatcagacaaatagatttcagagcaaagaatattatatctcattatgataaagggatcaattactcaggagtacgtaatttaaatatttatgcaccaagtaaaaaagtttcaaaatacatgaagcaaaacttgaattgtaaggagaaatagacaaatccaaattctagttggagagttcagcactccattcttaataactgatagaataagaaggcagaaaatgagcaaggatatggtagacttgaacaagactatcatccagcttgacctggttgacatttatagagcattccatccaataggagctgaataaacattcttttttagaacacacaggacgtttaccaagatgtaccatcttctggccacaaaacaagtttcaataaattaaaaagaattcaagtcatatacagtatgttctctttctacaataaagccaaattatacattgataaccacaaagatatctagaaacttcccaaattgttggaaactaaataacacagttctaaataatccatgggtcaatgaagatatcaaaaggaaaattataaagtattctgaactgaatggaaatgactcacttaagtgtgggatttaaaatgtgtaggatacagctaaagcacggctttaaggaaaatttctagcataaacatctacattagaaaagaaggaagatctcgaataaatgacctcagctttctacttaagaaactgaataaagaagagcaaatgaaacacactttatttcatttttatttcatttttcttctgtgggcagaagaaagaacattataaaaattgtataatgagaaaataaaaaatgacaaataatacagaaaatagagaaaaatcgataaacccaaaagctagttatttgagatcaataaacttgttgaatctccagccagaatgaccatgacaaaaaattaaataaaaagacaaattgtcactatcaagagaggtgtcattaatacagatctacagagattcaaagagtattgaggggctagccgaggtggctcatgcctataatcccagcactttgggaggccaagacgggtgaatcacttgaggtcaggagttcgagaccagcctggctaacatggtgaaacctcgtctctactaaaaatacaaaaattagccagctatagtggcacacacctgtagtcccagctactcaggaggctgaggcgggagaattgcttgaagctgggaggcagagattgcagtgagccaagatcactccactgcactccagcctgggtgacagagcgagactctgtctcaaacaacaacaacaaagagtgttgagaaactattatgagcagctttatgttagcacagtaaacaacttggatacaatgggaaaacttccccaaaaaaacaaactaccaaagccaataaaaaagaaatagactatctattaaagtatatatagaaacagagtcttactctgtcgcccaggctggagtgcagtggcacaatctcagctcactgcaacctccacctccagggttcaagcaattatcctgcctcagcctcccaagtagctgggattacaggtgcccgccaccatgcctggctaatttttttgtatttttagtagagacagggtttcaccatgttggccaggctggtttcaaactcctgacctcaagtgatccacccaactcggcctcccaaagtgctaggattacaggcgtgagcccaccgtacccagccttaaagaatatatattaaagaaattacatttataggtaaaaacctccccacaaagaaaactataggtcctgatggcatcattgtgatttttgccaatcatctaaggaagaaataagaccaattctacacaaacacttccataaaattaaagcggaagaaacacttaacaattctatgaggccaacatttcttagatatcaaaccagacaaagaaagaaaacaacagatcagtaccctcataaacatcaatgtaaatattcttaacatgtttttgcaaattgaattcatcaataatttaaaactatgatatatcatgaccaagtggggttaggattatttcagggacacaagattgatttaacattcaaaaatcaatcaagataattcacatattaatgaataaaaaaacccatatgatcatctcaatagaatagatgcagaagaaaactttgataatatttaatacacattcctaatttttaaaacataatttgcaggaagctagaaatagaagagaacttcctcaacctgataaagagaatctatgaaaagcctacagctaacattatatttaatggtgaaagactggattattttcacataggatcaggaacaacacaagggtacacactgtctccatttctagtcaacattgcatgggaggttattaggcagtgcaatcagacagaaaagaattaaatagcacccagatttgaaaggaggaagtaaaagtgtctatatttacaaacagcatgattatctatgtaagaaaaattctactgaagctacaaaaaaatcagaataattgaattaagcaaagttgtgtgatacaagataaatacacaaaaatcaaatgtttaaacaattagagattgaaatgaaaaacaatgccaaaggccagatgtagtggctcacacttgtcatcccagcagtttgggaagctaaggggggtgggttgcttgaggccaggaattcaagaccagcctgaacaacacggcaaaagcccatctctacaaaaaatacaaaaaattagccaggcatggtggcgcatgcctgtagtcccagctacgtggcaggatcacttgagtctggggggcagaggttgcagtgggctgagattgcgtcactgcactgcagcctcagtgacagagtgagatcttgtctcaataaataaataaataaataatgccatttacaataggacaaagaaagtgaaatatttagaaacaaatctaataacatatatatcaggcctgtacattgaatactatgaaagactgtggagataatttaagaagacttaaataaatgaaagatataccgcgttcacatatcagaagcctcaatactgtcaaactgttcattgcctaaaaattgacctatagatttaatgcaatctcaattaaaatcttggcaggctttttgtaaagaatgaccagctgattctaatattcatatgtagatgcaaagaaaacagaataaccaaacaactgcacactttgagaaagaagaacgtttgagtatttacactacctgagtatttacattacctgacttcaattcttgttatgaatctactatagtcaagacagtgtggtattaactttaaaaagagacaaacaaataaatgggacagaacagagtctacaaatagatttgcacatatattatcaattggttattgacaaaggtgcaaaggcaagtcagtggagaaagaatagtctttttaacagtgctgggatgattgcatttccctaggcacatacgtacagatacacactttgtttcatacttcagcatttataaaaactcattcaaaatggatcaccatcttaaatgtaaaactgaaatctacagaacttctgtaataaaatctttgtgaccttgagttaggcaaatgtgacaccaaaagcagaatccattaaagaaaataagctgcacttcaaaattaagaattctgatctttgaaagacactttaatttctttttatcttggagacagagtcttgctctattgtgcagaccaggcttaaactcctgggctcaagaaatcctcctgcctcagcctctcaagtagctgaagctacaggcacccactaccatgcctggctaaagacacatttaatagaatgaaaagacaagccgcagactggaaataaatatttgcaaaccacacatctgataatggacttgcttctagaatagttatagaactcttaaaactcaacaaacagctcaacaattggaaaaccaaacatccccaagtgtattagtcaattttcacgctgccgataaagacatacctgagactgggcagtttacaaaggaaagaggtttaactggactcacagttccacgtggctggggaagcctcacaatcatggcagaaggtaaggaggagcaagtcacgtcttacacagatggcagaaagcaaagacagagagcttgtgcaggggaattcctctttttaaaaccatcagatcttgtaagacttattcactatcatgacaacagcatgggaaagacttgcccccatgattcaattacctctcaccaggtccttcccataacatgtgggaagtcaagatgagatttcggtggggacacagccaaaccatatcaccaagtaaaggaaaagaaagaaagtaaaactgaaacagacatttcaccaaagaagatatctggatggcaataagtacaataaaatttgttcaacatcactagttatttgaaaaatgcaaatttaaactacaatgaaataccattatatacatattagagtgagtaaaatttttttttcagtggagtgtagggtttctttttttatttttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctggatacttgagattagggagtggtgatgactcttaacaagcatgctgccttcaagcatctgtttaacaaagcacatcttgcaccgcccttaatccatttaaccctgagtggacacagcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccgggcggggggctgacccccccacctccctcccggacggggcggctaaaaatttttaaagtgaccacagaaaagtatgggtggggatgtggagcaactgggaccctcatgcattgatggtgaaaatgaaaaacagtataaccactttgaaaaacagtttaaaaagttaaacaaatacctactatggggatccagacactctgctcctagatatttccccaagagaaatggaagcacgtgtgcacacaatgtccacacgatggacacacacatgaatgcctacagcagctttatttgtgatagtaaaaatttagaagcaagtataatgtccctcaacaggtgaatgataaacaaattgtgttatatccatacagtggaatactactgagcaataaaaaggaatacacctgcaacaagatagatgattctgaaaataaatatgttaagtgaaaaaaacagacaaaaaagtgtacatacagtataattctttttatataaaagtctagaaaatacaaacaaatctatagtgatagaaagttggtcagcggtttttgcatagaaactgggatgtggggtagggtggggacatttaggagggaggaattaccaaagggcatgagaacacttttttgggtgatggatatgttccctaacttgattgtgatgatggcttcacaggtgtacacagctttccacctcatggccacagaccggttaaccatccatataaaacatccattgccctgggtccaacctcctgccccctgtggaggtgaactgtctacttcaccattgatatttcaggttgtatgatatagtgcctgacaactctccatttttggaacacatccaaattgtttcttattcattttccatttctgccttcgaacgaatttcctgcactggtaactaggtgaagaattttggagttatctggggtaatggagacatcctccattgcaccgcatatttgctttctgtattccccagttatagaaatcaaaacgagcagttgtatgtgaatgcattgtatcaaaccaagtctctagatgataggaggcattgtcattactaggatagtaactcagtagaaagagtgaattgagaatatgaggaatgagagtggggtccagactaaaaggaggccaggggtcctgaactgccccatccaactgagttcattctgatacctactgatctgaagcagcaggtccacgcccaggtgcagattgtcccagatgaacaggcagaggctagagatgctcattcctaaagggatcaaataattctgagaatggcaagaactccattaactctcttctccaaaactacaaaaatgtgcagaaaatacgaacaatttttaggagcttacactctttgaagtttatccatgggctgctggaacccttaggaaataatagctagaagtgcctcagacactgcctggcacacagcaggtgctcaatgaattacactgcctggcacatagtaggtgctcaatgaattgtctgatgaagtgattaaggagccttgtaaatactgattaaaacatgtatcaccccatccaatttttcaaaccagtgcttctcaagaacaagcaggaaaattaatgtaatattgttttgaagtagccgtggtggtttcggggcagaagcccaggggtactccttactccgcctgctccagtaactagctgacatggaagtgcctcgtcattctggttcagacacaggtgcagatagatgacttctctatcccactttaattctccttgaagatcattcccagggacattcatttgcttaaattaacatgctcggccaggcgcggtggctcacacctgtaatcccagcactttgggaggcccaggcgggcggatcacgaggtcaggagattgagatcatcctggctaacacggtgaaaccccgtctctactaaaaataaaaaaaatcagccgggcgtggtggcgggcgcctgtggtcccagctactcgggaggctgaggcaggagaatggcgtgaacccgggaggcggagcttgcagtgagcagagatcacgccactgcaccccagcctgggcaacatagcgagactccgtctgaaaacaaacaaacaacaacaacaaaaattcatgctcataatcccactttcaaaccagtgacctcaaagatttctagcagcaatcctattccattcttccaattacagaaagcaaagagaaactggatctggggatctaagcgttgagcctgctgagcagaacggccattcatttggggtgaggtgctgactcactgcccctctacattgcattttggggtgtggggatttccagagcaggattctccagagaggagtatccaagctccctcctcccgcagcagggggatgctgggctaactgcctggttcggtcccccgtgagtggtctgctgtgttttggttctgtttgtttgtgtgtgttttgcctatgactttgcgaaatattccaagacaagagccagaaagtcttggtctctgaagacaagcacaatgttgctttcagcttaaatatctactgggaaacctcaagatttttaatgtcatcattatgaaaaacagagattataaaaggaaaccgtcgcatttcactcgctggcccccagtgggattggatctgacctcagtgtatcttttctttggtaggttttaagtcttgacaaaatgtgcctaagaatgaagactccaaaaaggatgcagtagattcggggggagtgggggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttggggacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacagtcacacagacatgtacacacatgcatgacacgcacacacatactaacagacatgtacacatacatgcacacattcacatagacttacatagtcagaatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacataacatgcatgacacacatacacagtgcacacacacagtacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcccggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcacgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttccctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagcctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcgtggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgttttattcattcatccatccatccatccagtcacccatctatctacgcatttattcagttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagagagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcgaggccagcaagtgtgggagagaggtgggaaggaggcagaaaggccgtgcagagccagctcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatgttggctgatgtccaggttatttccaatttccatcatttaaacaaaactggcgtgacatcctcatgcacctgttgcctcccacacatctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcactgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcatcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacgatgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggcggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagcgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaactgaggcgtatggaggaaactggggtgtatggaggaaactgaagcgtatggaggaaactggggcgtacaaaggaaattgaggcgtatggaggaaactggggcgtatggaggaaactgaggcatatggaggaaactgtggggcgtacagagaaactgtggggtgtatggaggaaactgtggggtgtatggaagaaactggggggcgtatggaggaaattgaggcatatggaggaaactgtggggcgtatggaagaaactgggcatatggaggaaactgtggggcgtatggaggaaactgtggggtgtatggaagaaactggggggcgtatggaggaaattgaggcatatggaggaaactgtggggtgtatggaggaaactgggcatatggaggaaactgtggggtgtatggaggaaactgtggggtgtatggaagaaactggggggcgtatggaggaaattgaggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactgtggggcatatggaggaaactgtggggcgtacggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagtgcggtgcctggacccgcctaggaggacaggggctgtgtctgtgccggccacaggcagtgactgtaagccctggatgagctggaggaactcagctttgtgaaccacagacccgcccgccgctcaccctggcactgggcacccctgaccccggccaggtggggagggaagtggctcctgcactgacagccgagcccagaccctctggtggaaacgccacattctacagacctggtgggaaacgtcaccttgggagcctcaggaacggaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccagggcctgcctcagcctgcacccctcagagctcctccgggctggacccgagaccccacagccgccccgatctcagctgcgttgggcgcgcaggggtggggcagttgaacatgattttccactttgtgtccccaatcagacctgcctgaccagtgcacgcccaacccctgcgataggaaggggacccaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagacctgggatgcagccgtggggctcttgggtctgggctgcgacgttcagggcttccagccagccctcgccttgagttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccctgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgatgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatgcagccacgggcaggaggggcccagggcaggtggcctgaggcgaggtcgcctgggggagcggtgttgcaggggatggagccacgggcaggaggggcccggggcaggtggcctgaggcgaggtcgcctgggggagcggtgttgcaggggatggagccatggggaggaggggcccggggcaggtggcctgaggcgaggtcgcctgggggagcggtgttgcaggggatggagccacggggaggaggggcccggggcaggtggcctgaggcgaggtcgcctgggggagcggtgttgcaggggatggagccacggggaggaggggcccggggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggttgggaccctcttggcccaggtgaggatcaggtggactccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaaactccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcccctgttccccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacgtggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggcagggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccgggaggccggggagagaaggtgcctgcaaggccggcgctgggaggctggggagagaaggtgcctgcgaggccagtgccaggaggccggggagagaaggtgcccgcgaagccgaggctggcgccgggaggccggggagagaaggtgcctgcgaggccggcgccgggaggctggggagagaaggtgcctgcgaggccagcgccaggaggcgggggagagaaggtgcctgcgaggccggcgctgggaggccggggagagcaggtgcctgcaaggccggcgccgggaggccggggagagaaggtgcctgcgaagccgaggctggcgccgggaggccggggagagaaggtgcctgcgaggccggcgccgggaggcgggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtccccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcgtttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccaactgggagcttccattttaaagaacaccatcatctctcccttcacaggttatgcgaagacccgcaaacaggagattttttgttgttactttttgattctgttgcaatatttttgttactttttctgattttgtgtgtttcagtgccataaatggttgttgagaactgatgtggcgggtaccagctagggacaggcaggacaggcgatgtgggtttgaggcgtacacagccccgtgggaaagagacagggaaaccagcacaattcactctgaccccaaccttggcctgcagtgcgaggcgcccagtcacaaatctgtacacacagtgatttggggtcctttttcctaaaacagcttctttatcaggactttggaattctgggtgagatagaaacactgaaaacagggcggaagttttttcttctggcttcttagtccatgggagggctcagcgtggagaggatatgccgtggcattctccctgggagaccacacatgttcccgacagctcagaccccagaccgcacgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcaggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagtgacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtaggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcacagtgagggcttggcacacaaacgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccgggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctaccaagaagcccgtggaacacagccccctgggccccaggagagccctgcactgcccactgcacggcctcacacggccacaggggccacagccgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggcgcctgcaccaggcagcttcgggggcacagcccgagctccagggtgcccaggaaccgcccacaaaagaccacggcaccatcggcgcccatagagccttccctgaggtaaagtgagagccttggggactcgggaaatctgtggcacacttttcttcccccacaggcgctcgtgagtgcatctcccggcgctccagaaacctcctggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccactcgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcaatggggcgcctgtgacccactcgggacccgtgacccactcgggacccgtgacccacccggggcccgtgacccacccggggcccgtgacccacccgggacctgtgacccacccgggacctgtgactcacccggggcctgtgacccacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacatcgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttggtgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccgcttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcattaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagatttt

SEQ ID NO: 33 - DNA, 2309 bp, Homo sapiens
  misc_feature (1)...(2309): n = A,T,C or G
cgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcngacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcacagtgagggcttggcacacaaacgcaggctgctggggcagcggcctctgagccaacctgggagggaccccgagctgggaccgagggccggaagacaccgaggcagcgcctgcacccctgtgccattcccgtccccaccctcctgcaca

SEQ ID NO: 34 - protein, 510 aa, Homo sapiens
APQLLLLLLAAECAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQADILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVVDYHSTKKLKKQLVVLAVEHTALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 35 - DNA, 39084 bp, Mus musculus
  misc_feature (1)...(39084): n = A,T,C or G
ggtgtgaacaggtgaccttcccaaagccactgttcagctgcccaacagcatctgacaggtccaaacaacacgcgtgaggtcccttctcctctcagtcatatgtatcgggatgcactgagcccccagaacaaatggctgtggcatgggatgccagagtggctctgataagccacgcaaggctgcaacttcaaagagacagggagtagaagcaagtagcagtggaggcagggagactgtctagaaagagcacaggctgaaaatctggctcaaatcggagagccagactctgaaagtcatgttcgcagggacattagctgacggtgaggcccaatttctctctgtagccctttctgctaatggcctcttcctttcttgtggtcctgccctgataccatgaccccgtcctggatgcttccttcagtgggagccagggggttagtacaattgtggcaggaagactcacatataacaaagaggagaatgccatgtaggagagggagcaagccagcctggtagagtggagactggcttcacaggcctgctccctctcctaaatgacaccttctttgttaggtaagagccttcatgcctttacccttccaccccatggctcctgttgaagacagcattttaaagagggtcttggtgaagctaaacggattacaggaaaggagtctgttagcagaaaaagactatgagattggagaggggaatagggaagaggcgctttacagtgtgagacaagcattctggggtgaggggatcccaaatgtactggctttcccttaagtgggtcacttcccctaaagctttgtctttgccctgtgcaaaatgaaggcattaaatccatcccgccacctctgcccttaagcgtgtttctaaatctacctccatgccatcagccacggaccccgctgaccagcagggggcgctcctgcagaaggttgaccacccttgccctaggcaactgttgctctcagcttcttgcagggttgtcagaacagaaaaggtactccccccacttcctgtccctcccagtccactcgggccacttttcttctcaagctctccctttcaattgtgtgttttggaattagcttgctaggaaattactgactctaggtccttgggggaagtcattttgtttctctgtgcctcagtttccccacgcaccaaggaagtatgagtgagagactttcacccagagaggaggtagcaatgctgctgcttcataatcattttcctcaccagggcgaaagcggctgcttctacttcccacaaggacgagccagagcctgccgagactgtcagagtaccagctggtctatattattttattttagttattttatgtaaaggatgaagtgattctagtactgtgagtgatactcaaaacgttggaagtaatagggttttgaacacacaagggtcacgttggaaagcggtttcattagtccttaaatttctcccccatcttttctaagggcggcaaactggggagatgagtctatttaatgagtggggaaactgagatcccagaaggatccattgttggagtttatgccagtttctctccgtaatccaggctccatcccgttggagtcagcgactcctattggagacatgcgggattacagcgatgtctgtggacactggtaggttggttttcagtaacccagatggagagtctcaccttctgttgcgtttcaagcacttctgtggcaaagtgcttgtccccgtggataaagcaaggaaaagaaggaccagaaaaatcattgcaaaatccaggtcaaaacacaacagcatctcagtatagccctatacaacctccccgggacaacgggtaaacggtcccatcatcttatttagcaggttcttctctttactgtagcgggtaaacacattctctgacactagttccatgggttctaggtttctgggtctaggccaacaaacaagccaacctgagcctcagtttcttgtgtgtaaaatgtgaggattaaataagttaatactagctaggctgtggtggcacacacctttaatcccagcactcaggaggcagaggcagggggatctctgagttcgaggccagcctggtctacagagtgagttccagaacagccagggctacacagagaaaccctgtctcaaaaggaaaaaaaaagttaatatatctaacacattactcttatatagaaattagtttatccttatatagaaatgccagctgccattaagtatttgttaattattaattaattaattaactaatcaattaattaagcttcttaactgactgtaatccataaaagacaatcatggacttaacctcctctgactcacactgctcagcaggagatttttttttttaagatttatttattgattatatgtaagtacactgtagctgtcttcagacactccagaagagggagtcagatctcattatggatggttgtgagccaccatgtggttgctgggatttgaactctggaccttcggaagagcagtcgggtgctcttacccactgagccatctcaccagcccccccccccggagatttttgactaaggaaacattgttaaaacatatatgctgaatgctctcttgtctttctttcttttcttttctttttttctctctttttttttcttttttcttttttggtttctcgagacagggtttctctgtatagccctggctgtcctggaactcactctgtagaccaggttggcctcaaactcagagatccccctgcctctgcctcccgagtgctgggattaaaggcgtgcgccaccatgcccggctttccttccttccttccttccttccttccttccttccttccttccttccttttttttttttttttttttaattttgagacaaggtctcactatatcaccctggctatcctggaactcactgtgtagaccaggttggccttgaacaaaatgtgatcttcctccacctccccagtgctggacttaaaggcatgcataccaccctcccccacccccagctcgacattctttcttaaacaatacagtataacaactatgtacatgatggtcacaccttaccattgtaaatgttacaaattatacataagcacacaaagtatcaaatttatatatacaatgtttaaaattatacaccataaaattacaggaaatgtactatttttcagacaggttctattgtagccctggctgtcctgtaattcactatgtagcccaggctggtctcaaacacagaaatcagcctgcctctgcctcctaagtgctaggattacaggtgtgcataggcccacctggcatgtgtgtgtgtgtgtgtgtgtgtgaatgtgtgttctaggtttactgtttcccagtcttagcttattcccagtggaaagaaagaagtctcgctagccccttgatgtcccgactctaagtgtaggaagaagtactgagccatctaccagccggggtagttgacaacacttcttgcaaatgtacttgcacctgcagttataacaatgtgatagtatgtcctagaagaaatggtcttagtggcaagcaggacggaagtgcattgctccagggactttctgagcatccacatgggacctcttcctctcacctgtcctttgcagagaggacacctgtgtgcagagttgcatgtttttggtggtgtttctggtacattctggccccattcttctgttttcctaggtggttggtgtccttgcctttctcctcctcgcctttccttcagttttctttccttctgtgggcagagtcggagacagtgccctgcatgaagaatctccgctagggtgaaggacagatggccccccagtgcatgcagtctgtccaggcatcctgctgggctctgacacttctgatagtgactaccagggatggggtgtggcactcatctacagtgggcacagtagccaggcagagaccaaacatatatatcacttgtcacataggaatccactggcaaccatggagcagattctctgacactgggattttacctgggggtcacttcttacctccacgtgtgtccctgaggacagaactggcctgcagagaatgttctcactgtgtcagaagaaagggctcaacctctggctcatgtcatgaggacctcccctctctccttttcttttttgagacagggtctcactgtatatagctctggttttgcctggaactccgtatgcaaaccaggctggccacagactcactgagatttgcctgcctctgccttctgagttctgggattaaggtcagcacaattatgcctggctagggcagaatttctaaccattcataagtcaaacttgacagctcaggatcattcattcattcattcattcattcattcattcattcatgttttttttttgttgttgttgttgtttttgctttttgagacagggtttctctgtatagccctggctgtcctggaactcactctgtagaccaggctggcctcgaactcagaaatctgcctgcctctgcctcccaagtgctgggattaaaggcgtgcgccaccactgcccggttcattcattcattttaacccagtggttctcaaccttgctaatgctgcaaccctttaatacagttcctcatggtgaccccaaccaaaaaaattatttcattatttctgcatatctgtaattttgctattgttatgagtcataatgtataaatatctgatatgtgactccccaatgggtcacaacccacagcgtgagaaccactgttctaatacgtatagatcccttaacttgaagccaaagtgcataccctccttgacaggagctgtggatatgaatgaagtaggaggaacctgaaggtgcaacttggtggtagggtgcttgtctaggtgcttgtatgtgaggccctgggtttgatctctagcattgagggagggagggagggagggaggaagggaggaagggaggaagggaggaagggaggaagggagggagggagggagggaggaaggaagggaggaaggaaggaagggaggaaggaaggaaggaaggaaggaaggaaggaaggaaggaaggaaggaagggagggaaaagcaacaaggcacaaggctttcagcttagtgagaatactaaacatctgaactcgagggtgccatgcaccttgcatgggtggtaactggtataatgtatcaataaagtttctcaagtcaaagtgacaagcaagccaaggctgggatcggtcaaggcttccaggagaaagccccgtcaatggaagcagcccattttggggtgcttaaggacacccctccacattcaaccctccctggttaagggtaaagatttagccacgtctcaggcaagtgagagagggcctgtgtgttgatctacacacacacacacacacacacacacacacacacaccagaatgatgatctagatggaacaagtcagaagagaaggaagtacataagatctccagttgaaattgctaggtgcgagatggagcaactccaaaaaggacaagactctttgaagagctgatgattgaacaccacggcactggcccttcccaaatactctctcgccagtgcttaaagttccactgccactaattccttctgatcccccccctccctcctctctttctccctctctccttctttctatcttgggtctcgcgtagcccagactggctttgagcttctgtgtagctgtagctgaagatgctcttgagccttctgatacacttgcctccatttcctaaatgctgggactccaggtgtgtgccaccaccatgcagtgctggagatcaaacccaggcttcatgcgggctaggcaaagcactctaccacccgagtcacactcccaagccacacccccaactcaccttctccttgtaaatgagtttggctttaatataaatgtcaaccatgcttgcaatagaacatttggagaatacaatccataaaccataccccaatcttcaacacacccatcgttaacattttggtctttctctctgtcctttctcctttggggggggggcacattttcaggatgtggtatgggtgtcctacgtggggattctgatacctttgttcccacttagctttggtcctgtttcaggcaggttttctggaaacagcagtgagttctgtgacctccaggaagctactctctggacttctgtcttcatccatataacggggatggcgatgacacatgggctgcctcacaatgccccagagtcacacgcaagagaggggtcacgaggacgctggccaagcagttcagatttgtggggccgggactggtgggaatggtcaaaacaaaactggtcacagtgaggccccagcagagaggctagggtattgggagggtggggaaaagaccaggagagggaccagaccacagagtatccttggacctcctggaaccagtctccttggcagctgagttgggctctggatgtgactgtggatccagagtccatttccagagcagctgctgagagggaggctgcagagagcaggctacctgggatgatgcatttctgcttgctcaggacctggcgggggctcagagggtcttctgggtgagctcttgctagggagccaggcacgggtggttcctgaggctttgtttcaggatggtggtctgcctggagcaaggagggtgggacaaggaggaagacaaaccgaagagcccctgccccctccagctgagtttaatgtagagtgaaaaagctttgtagtgtgctttcacctccagggctttgttgttgttgttgttgttgctgttgctgttgtgtgtctctctgtgtgtgtgtgtgtgtgtgtgtgtgtgtgttcatgcatgcatatgtgtgtctgcgtgcacgtttccaatgggaggggaatacttcatccaagcagtagctgccttgggctggatcatagaaacaggtagctgcttgtgcatgggtaagaatgcctctcttgcattcctgtgtgaacgtgtgggtcaaagaacagctgtaggtctgactaggaatttagacatgtgtggggtgaatgtaggagaaggggtctgtatcactgaatgcctctctctctctctctctctctctctctctctgtgtgtgtgtgtgtgtgtgcttatggcatgctcactggaacatgtgtcagtataggagggagtgcttctgtgagcatgtgtcagcatgctactcatgtgttagcatgatgctctctatctctgtagcttcctaaaaaaaaaagctgcagacccatgaaccaaggttatgagctgttaatgacactgtgtgcacatattatttgctagatcatgtgcccagttctgaggacactggagaggggattgaagttcaactttgcccttgagtttgcaaggcagggctgcaggtgggagcagaggaacaagccactcacagcacagtgctgtctatctcaaggtcctttctcaacgctgcaattgtgaggtgatctgcttcaccacccatctctgcctccagaccaagcttgtctccctcgagggtgagctcctaggagcccctactggactctgaaagcatgtgtcactcaaaggctgctgagaatcaggctgtacctgtattcctaagccatccacagccatcctgacccacagcaaatgctggcagtcgccccacagctggactccgttcctccctccactcctatagccgaggctatccacacaggctatttcagtgccctaagccttgctacccttatgtatacattgaggacaatgactacccctgtttcccagggtacttgagactccttcgagaccatggctggggctggggttcaaacacccagggagtcccatgtacacacagggagggggattgctgtgggaatccctattgccagcaatgagaagctgtctccggtgccctgcggagctgtgggggccacaaagtggaagcagcattgggaggtttcctgctcagagccgcccaggaggcaaagccctgatctggtcctaacttgggaaggaaggagccttggggcggggcccactgtcctggctgttgggattcaagatcatagaatgagcactttctgtgcctcattctctaaccaccaaggtctgggttgaatcttaaggtttccttccaaccttcttcaagttcagcctgacagcaacaggcagctgtgtcacttgggggaccgttgttccctcttcccatcatcttgtcttctctgtgcatatgtacttgtgggctttaggacaggaagggcagtcggagcaacccaaggtgaactccctccctccttctctgccaacagtagggtgccagtgggtactgctgggtgttgctgatatcttcctgttagcttagtcctcagcactctcttggactcacacaggtccctctgagctccctttgcctctgagcctcctggatccccctgtcacacttttacaatagaggagacagagccagattctgccagcttgctgagatgaccgcacacatgtctccccatgctgtcatacacgtgaccataacgatggcttaaaatcagccttggaggggacacttacatccacagtccagaaaccaatgaacaaatcacagaaatcacgcagcaatccctcatcccccagcagagtaaacatcagcccacggtgctgggctcctgcctgcaggcataacaacccacacctcactacctcctctctgacatctcatctacacaaaaatcttgtcagttctttgtcatcctccctgtttcacgtctggaattcgtagttcacgtggttgaattccaggtctctgaagcctatgttgggccttgcagcctcagtaaacaggaccaccagatttgataggaccacagagctgtggtagcaaagggtcatgtggctactgagttgctccacagtgaaacagctcaaagaggctcaccaccatagccaagtttcctctgttgcaacagcttgatgtcagaactggcataaatcttcctcgttccaggccgatatcctccacaaagccaaggtcactgtcacccaatgttctaactccatgtctagtttctttcttttccttccttccttcctgcctctctttgacattttgcaccaagatttgacattcattaaagccagattgtggctttttgcttgatttggctcagtgttcaagatgcccaaaggcgtttgaaagctcatttggttgtatgtctccttcctagactgatgtcacccctgcttcgttgtaagaattggagtcaaacttttttttttcttaaagcaacaggcagcattgaggcccaacactaaggagattcacgttttatatgatggagatctggcttctatgcatctagggagtccgcttcctcctgcttctgtggctctgcctcactcctcagacagtgtaaatttttgaccagtaatagtgttgtcgtcatacgagagccctttacacctccgccgatggctgtcagtttcgtgtttaagagcaggtaccctctgtatgaggttctatgtctaagagtcctcctagccaatggacatgaatgtctcccgctgttggggaaggactctgcgcaggacctctctctcagccttcggaatccctgagcaaagaaagctgaactcgctctacagaatagtgacgaccacgaacttttgctatacagagatcgcgcacccgagcatctctcccgggagaggcggcatctctgaggcagcacctcctaggtccccagaaccccaatcctctccagggccagggtcccacacggtccgccttctttgctggagtgggcgcggctccaggtgagcactcacctgagaaggggaggggcctgctgctgacccctcccacaacagggcgggcagagttcggcggagcctatggggcgaggggctcgccggctgcgaggctccctccccgggccgctcgcgctccgccctaccgggtttaaagccccgcgggcggctggtggcggcgctacgagcgcctagtggcgcgaggagatgcgagagtgcaccggccgcctgcaccatgcgccccgcgcccgcgctggccctggctgcgctctgcctgctggtgctgcctgccgctgccgccgccgccgcctacttcgggtcagtgccggtcgcgtcccctcgctccgtatgccctgcccccggctcgggtccctgcgaggcctcgaactcagccctttgctcaggtggaccccgatcgctttgagggcgcatttccctcccaaatctccatccctcgctctctgtgctcagacttaatctccctttctcgagtctaccaagtctaggtcccttgcgcttcccggttcctctgccgggcggctgtcagactgcagactggagctcggcttgcgcaggggatcctgacctgacacccctgatacgcccttgtccgcgcaggtccaagcgtcggtcctgggctctcatgtcctcttcagatctttctcggtaccctctatgtccccatcctggactccgtccagctacactttttgcttgcgatttcagtatcctttgctttctccctgcagagctgggacccggacacctggctgggtagagggataggtgggtaggggtggggaggaagctgagagttttgttgatccaaggttgtgggagatcctgggaccgcggggcacattagttagatgcttaaagaactgtacggtgaggaagtgcgaccaaattaaaccccagaggatagggtttatgggaaagagagggagagaggcccatctgggggtgtccatggttagaaaaataacaatagcttctggtgtgatacctggagagtgagtctcaagggaaataattgagggaagcaaaatggcatttgtctgcaaatgtcttcactgactctggattgaagatacttggtgagggttgggcgtggcggtgatggtagggatcatggattttaaaaatcacctcaacccaaagcaggctccaaatgcttaactttaaacattgcctttttcttccagttacatccctagtcaggcaaggctcacaatccaagcacagcagaggctgatctcaggaaaccaccatagggtgtgagggtccaggggcaacctcaccggcttgaataagggatgtaggctaatttccaggtcatgacctctggctaaaatgtacctgagttataagcagcaacctccccagaagtatatggggagggatggtcagtctcagtcctagtggaggtccctgctgatgatctgggaggaccattcagttcctggggactcagtatctccgtttgacccgcgcccagaacagcagacatgttcattgccaagaacttgccccagtggacacgactcaagggagaggacacaagctctgagttcagtcctgccactttcacggcactgcgtgtctggcctgtagaatgtggataagagtgtctgaggggagcgcatagaaagctcttagaacagtggctagcatgtagtaaaaactcaggtaatgctattgaggatgacggtagaggaaaccaagagggttctgggtatcccagactcaagtgtctctctgagctggaatagaggagcaactgaccccagactgtttccacgattcttttctttctttgggttttatggttggagacaggagtgaaggtccgatgatgtgggaagagaagggttccaggaggcctggaccacactggctggtatgctggaagggaacagatttggggcctggggagcaagggacaatcttgaaagtaacaggggagatggttagttatggagagagagagagagagagagagagagagagagagagcttgattttggggtccttccttgaaagagctgaaaagatacacatacaggcttcatgctgttaactgtttgggctcagggaacgggcaggactcatcagggcaaactctcatgtgacttaggtggcccaggtttcctagcctagcaccagtgtttgcttccagccatccacacttcagtgagaccatgaagcagtgtgcttatccctccttaggtcactcgcctttgaagtctcatttctaagtataacatgaaatgctttcttttatttcctgatgaaaggaaattcagagatcaggagaacaggtgacagcaattttggtaccaatctcgttgggatctttgcagtcaaagacttcagagtgaggaatgaccaaccccctgcttcaaaaaaggtcacatcttatccccatttttcagatcccacgtgtccccctcccaagccacagggagcaagcagtggcttttgctgcctacagcctggttcagtgggtggccatggtgactttacaaagcagagcagatgtctataaatccctcccgcacaaagccccttccctcagaggcccctcaaagcaatttctgaggtaggttaaaaaaaaaaaaacagccagaaaggtccagagggtcacttggtgttacacagcaaattggtgaggggcaagatagaagccaggccttgtgtgttctccatcctgtatagggaacagcctcataaggtgtccttgtgttatgcctgagggaggcagcggctgcagtgggtgggccttagagagtggcctccttctcctgcttgatgaattctctcagaccctcttggccatagtgagagaggccacaccttcctcaacagtgagacgggcagaattccatgcaccttctagtccatcaggtgggttcctaaaggacagcagtgggacaggaagtggctggaacaagcttaccctgagcacttagtacatcataggcaccctgctggaccgttcactgcccagtctgcacacctgccctttagatgggcattgtcatcagtgacaaggtcctgatgtcctttatcatcggtcccagcaagaataaaacatctgcctggagtcacatagccagcagcaggcaaagctaggattcagacctgagactcaaaggctctgctttcatagtctttttctgatctgaccccagagaagagaggaagccagtgcagaggctgcacgcttgcaaaggaccaccaaagccaaccacacgttagagagctgtatccacgaggtagggagatggctggctcttcagtaaagttcttgccttgcaagcatgagaacctgagcttgaacctcagcactcatgtaaaaaggccatgtgtgctggcatgtcccatccgtgttggacaggctgagacaggaggcttctggtctcacagagccagctagtctaacctaacttcaggccaatgaaaggccatatctcaaagatgaacagtgttcttaaggacagcacccacagtcatccctctgtaaatgagcatgcacaggagcaactgctagtgacaaagatcccgggtgacttcaggactgagttgggtgacatgacctaacatgtgcagaacccatgaggtagaagcagtatgcttgtctgtcaatccagtctaaggtacaacaccattaggtaaacccgaacttccaggtttgtcagggaggggagacttggaatctctaggtgctaaggactctgtagacaagcgacttgatcaaaatggtacaatggacatctcagagccaggactaacttggcctctgagctctgtccttccccgattgtcacagcaccctgggaaagcctgactgatcagcagtgggccagtttaaaggttctttttctgctgggctgtccaggtactgcctttgtgggtctatggaataaataaaataccacctgtatttcccctccaagttcccattacatatatgctacactcattttaaaaacactgtcaaggtctttcaaatcgttacacttttataatcacttagagtgaccacaattactatatatttgttgatcatgtttattgaggtccagcagtattgttatatatgtcaatagctctttcctctttattcctgagttgtattctattatatgggcatgccacagattttttactgactccccaattaatggatgtttgagttagttctagtttttagctattaccaacatggctggtgtgagcatctgtgtataccccttttgtagactgtatgtatgttcccttgctctttggtaactgtctgggggactggattgttgaattgcctagtaggaatatttttaatttgtaggggatcggggcgcagtttccaacatgactatgccatttgcataggattgtatgggcgttctagtcgctccatattgccagccttcatcagtctcaattgttgctatcttattgggtctgtactgatgtctcattgtgttgtcccgttggtgaatggtgtgttgaacatttattcatatgatcattagaatatgtattttttaaattggtttgtttttctatcaaccaagtctaggtgttcttcgacacctactgcactgtcagctttttctcatatgccttttcttcctatgttctcttcagatgctccacaaactcctcctttacacttaaatctatgaattagggtgccccatgtgaggtagggatccaggcacactacttcactacttcccatgtgggtctttatagtaagtcagaggcgaagtaccacaaattccctaacttcatctttcttttcaaaggttgctctagctactcgggttctttgtgttttcacacgtatagattagcatcagcttgtcaacatctatgcaaaagcctgcttggatgtttactgtgactgtcctgagtctagaagtcagtgcacaaaggactgagtaggctgcttcatgaacaatcctgtccatctgcgtggggctttaattttgtacttctcagtgtatatctatcttacaatgttctcttatgtggggaacaggggtgtagggttgagatagggtctcaggtagcctaggctgccttcaaacttactgtatccctaagtttgtcattaaaattctgcctcctagcctcctactccccaagtgtgtggatggaaaaccagtaccaccatgcctggtttaggtcttacagatatctttttaaagtgtttttcatgtttagatactgtcatttttattcagttcctctcccaaacttttagaaatgggattgagtcctaggtaaagcggggcaagaagaaagcagttaaagaaactctccctgctgtgggatggtggattaaaggccaaccctcctgataatatcacggtgtctgaaggaaggactttaggccgactgcccctggttgagctgtgatccctgaagacaaatgctttagatttgggctctgggtcaaaccaggcacctcagtgagtgtggtaacttttctccagggagaagtggattgggggaaagggaagcaaagcaggaatcctcccctactggaagatcatcgtctgagccggagatattcgtgccttagggatcttgtactaaggcagagttggtctcaggaaatgggccagatcacctgctaggattggtatcaacctgagcaagatgagaatggtcaaggctgggctctagtgcagcagttctcaacccggggcttgcaactctatgctaggtgtcaaatgacccttccacagatcatcagaagatgcagatatttataataagattcataacagtagcaaaattacagttgtgaagtagcaatgaaagtaagtttatggttgggggtcaccacaacataaagaactgtattaaaggatcgtagcactaggaaggttgggaagccctgctctagtgtaacgggtattggactagctggataaggtgctgtgtgcgcctttgctcccagcacctgtgaggcagaatcaggaagatctccgtggactcgaggccagttaggtcaggatagtgagttccagaccagccagggttactagactccaggctagacagatcaatcttcacatcctccacggaaacttactaaatgacataggacgagtcagccattttcacttcggtatgggaaatgggctgattttttttctctctgggttgttgtgggggttgattattgcatacagggctgctctaccactgcgcatgatggtagagcacttgccaagaccatgggttccattcctctgcattgcctgccttcaaaagagcatacaaagtgctgtgaaatgtcactgtacctccacacccgacaggaggcaggcaagaatccgaatggcctgccttacagcatcccatgttaagcgacatttttggcaacatctgttcctttctctctacctctttcttccagctgtcctacaactgggagcaaactgaggttttcccatgctcaccagtttccacacatgatgtcatgttgccatttcgatatcccaggagggaggtgccgggccggttatatcatcaatggagacagcgtacagagaccaagtgctctgcccaaagtcacacagcacatggctagctgtgcaagatcgaagtccgtctagtttgtgggaatgctgggtgacctctctgccttgttcttcccactcagtaggcttgtctgcacccggcagctccactgtacctggcctgggacctctccacccattcctccaccgtggctctcgtccttcactctcatgtgccgcaccttctgcacactgggccctcagctcttgctatccaagtctccctgtactcacttctctagtttctcccagagaaccctgtgaccagaggccttaggatcctgggtcctgtccttatagtctctgatgccagccctgaactacagtggctgtccaggtagatagtgctcactgtctcttgctggcccccctccccttgcgccccctacaactgctcatttatagatacttgcacttcactaagccccgtaccattccctgacctctctctgtcagcatgggatgtgaagaggaacagaggcaagccttgcctctcaggcttctgggtcagtcactttgagcaagtttgtgggcagcagggctgagctgggggaggagaactttgcccagtggttgcctccatttgggacccctcattggggaaatgaagactggagagaggatggagagactgaaggagccaggatagactttggccagcatattctggtcaatgctggaatctctgaggccggatggacaacaaggccaatggatctgctgtgacatcccaatagcttctaggccaggtacagttttaattcaaaacacgtctcagcttacagaggtcatatggtgtgcttgcccttacagagcccagcacctagagatagatagacacttggttaattttcatagagattactagtaggttaggataaataaagaccatgacactctttggtctgaactctgggatgggcctttttaccccagggtgccaaaggccctgggtttcactgagctttctagagtttgggttactgataaaggtttgtgaacccatggtaccacgccaccatgagaggttgcacaagctgctttaaagaaagaaagagatgggtcagcttcttgactggtcctcagcaggtttccaaggaaatgcaagcacatatccacctcaagatgtgaagttcagagggatctggcccagctcctggagacctcccagggtctgcacttgaagcctgagtggccggatccagaaggccctgaagtctgctgctggccagaggatgcaacagtaacaagggtgagggcaggggatggtgggtatggccgctggcaggctcctgaagagccctgccctttcccaatgtcttccctgaaggtttgcaaattaagaggcggtgctcctgcagcctgtgagcaaggctttaggggaagccattaggatgagtcctgaggagtctgacaggaagcacagactgatcaacaggggctaatgcagccagcaggagcctgaaaaacatctgaactgagggaatggtgagctagggatagcctctaaggctccagaagccatgcgagcccccagtaaggaactcacctacaacttggcaaaccaaccatgtagaactgaaggcactatgtacgtgaatgtgagaaaagacgaaaacggagagaggactgtcaaataagaacttcctggctagggagacacacagtgcccaggggtcacctttcccacttcctgccttatcgaatcaagttttttcaaaggcagtgactagaaaagtttctaggggtctttgcaggcaggagtgatagcttgaagatggatgtggcagcaggactgagacagtcctggcaggaggatgggaagagcctatcagggtccaaggggattggccctctgcttcacccctggggttctgctccattcccaagggaacatcttgggctccctccccctccaggctgcccagggccactcttgctcttcttgagtatttagggggtctatctggccaggtgtgggtgctcctcccctttttggagaagagagtagtagctataggtatccccgtagccggcaagaggaaagtgacacctaagtctgagcgcttggtttcagagagaagacggtccttgacccagagcaagcattcaaaggcatggattttcccagcctgagccttggcccatgggaagagggtgccagccagagtcaggaaacactctggagcctgccaagctaatgagggggtcaggatgctctagctgagtcactcagcctgggagccaggatgccacagttaggatggaggtgggggaaggggatgatgcatccttgctcctcccccatagcatccaccttgggcatctctgatgatgctcttccagagatgtttggagcctgtgaacccaaaagatgttttggggctgtggaagcttgtctctagagctacgctaaaattagatttattctctctctctctctccctccctcccttcttccctccctctctccctcttccccatctcctataaaatttagttcttatacaccagcactgtattctcgcactttaatacgaatgcacagaccacttctgctaagccttatttcttccgtcgtcgttgttgtttacagacaggatttcactgtgtagcactggctgtcctggaactcaagagatcggcctgcctctgcctcactagtgctgggatcagaagcgtgcaccgccactgctgggctctaagccttatttctgtcttgctgctgatgagactcaagttcagaccagtaaagtagccttttcaatggagggtcttcctctccctaatcgagatcctatctcccagtcttcccaactaatcaggaggctcagggcaagtactgagaggccttcctctcaaacacttagcactttgggttttgtgtcctcggcatctcaggcattggccacaacaatgactagttttgcctcctagaaacctttctatgttcaagcagaaacttccaagaaatgtgtcacatcccacccttgctgtggacacctgggatgataaatcctacatgactttcatgggcacatgaccttccttctttcttagactctgtcaccccccaggagtctccagggcaaaacatatgggccagagaaggcactcctgacctcctatgtcatagtctcagggatgtcggactatacccagctgaagccccgtgaaatgtttgtaattccagattttcagagaccaatgatcctaagcccaggactggctttggggaccctctctggccactatgccacctgagcaatgcatgccagatgtgcagagagatgagtgggatgtgggagtgtttcctctgcagatgttgaaccagcggctttaagtcaggacaccgagagagatatagaatgctctctctgtgactgactgccactactcagccccgacagcggctctcggctctgggttgccatccttggctcacagcctggaagacaggaagtacagaaacaaagcccacagttgggttaggctctcttctctcttgaggaggcaccagatcagtatgagctccaggtaggaggttgtggccagctctcttccctagggttaggcttctgggctgtgaggttgtgtagagtacagggaatggagtcgggggaaagcatcatgagtggttctgtgtctgtgcccaccaggaaggatgcttggtgaatgacaggatgagacagcacaggaggaaaggctagaaagactgtcatagaggagggaagagtgcgcaccaataggcttcgaaatacagatatcttcatgaggaaattgcaaggtgacccaggagcctcaggagaagggtccaaagatgaagagcagtgttgctgcccaggagggcatggaaaatggaggcgagaagcctgaggtggctgttagaataccttctcttaagaatgactggccagtgtccaggcaggtgctgtcccatgaagttgcctctggctgggaagaggagaagggggggatagtgtgcacaagtatgggggtgtagccaggggtgtgggagtgtgctgaggctcagacagggccagcatgcccccaccccagatgctcaagatgaaagcacaaagggagtgttgaccatgcaaagggccccacagcggaagctgttatcaggaccatctaatggggctctgcagggctgaggccaaggccccaggcgacccaggctttcctgattctcaggcagaaaacgacctgtagttggcatgggccctggtaccaggctcagctccttgcccctccaactagataccctggcattaatttagtgctgtgggcaccaactgcatctccccacccaacttagctacccacttcctggagcagcctcaagtggaacccatagatcatctggagcagaaaacacctggaggaacagctgtcttccctagccgggagtgcccctgcctccatctgcagctggcgagatagacctgggcaaggtcaggctgtcactgagagagctcagctactttttcgttccttgggcagctaggatgattcaaaactgctttctctggatccttggactgttagagagtttacgtgactctcggatccaaccaagttccttacaggttgtgaatttttgggaggcaggaccatgtttttagatctggcactatgtatacagttggtgcttcataataaaaaccttatcttgggcttactgtgtgccagagactgttctatggactttccaggcattaaatggcgtgatcttaccaaccactctgagagatagagattgctactgtcttcctttcacagaccaggtgcccagaggcacaggggccttgtcagcatgtgtgcttgcttatgaaatgggatccccgaggtcacctctgaatgaggggaaagctggggaccagactcctcagagcagagcgttttgggagacatgaggttctgggattctccatgctggtgagcattctacttcttttgaagcctattgaggggcccctggggtctatccgtagttttctgctgcttcctgaaggggcatcatgatgggtcagctataaccaaacctgtggatgggaaaagcgtgaaaggaagagggaccaaaagggccagtgctagacagagaatgtcctaaaagtcaaagccaaaggatactacttgtctatcatcagtgagagtaccaggaaccatggacctgcgccgtgacccgagggactcagcactgatgatgaacagaaggacactggtcattgggctattgttctgtaaggaaaaggagaggtcgggagccagggtggtggttggagacaggagtgggagcccagctgggccagagcacagacatcttgacagggtcctggccccagtggctccggagcacggagtcaggcagaggtcctaaggaactgctgtggccactgtcccaaagcctacttagcaagctcataagctccaccccctcttgttatttcaatcctggtcacaggtgagattgctccctgtgtgtgagttcctgatcaatacagagcagcactgtccttacaaaatccctttggccttagtctcttcagttgtccagttcagtcccaaacgtctcaactaacatgtggttggtcggaaggtggaggcctagaactctgtgtgccagaccctgcagcagctggcaaagactgtaatctgcaatgcccaggaatgcccaggattcttgcggggtcaggaagaaccttccacactgggtacaatgggaaaggtgagcagaggggaccttactgaccctgtaaggaaagagacaagccattctcctttcgctgaggtgacactgcttcttccaaggcactgttttccaaactgtaacatagaaacccacaaaaaaagtgacactgagttctaggtgccctccgaggcccttttggggaccccatgaaaatgctggggagcctcttcccagagtctctctgggttgactggggctcaacagggctggaggcctctgtgtgcttggctgcctttcccgatcattaatcgctactaagtgtcattactgctaataaaattaacggactttatactgagcgtctggagccatcaatctcagggcctattacaatgaatttaaagagcaggtgcctgctgatgagtgggagcattgtagagcctcgagtgctgccggtggaattgtgttactttctagccagccacagcatgccaccacaaaggacaacaaccttagggagaccgagcaactcccagccgtgactccacagtgtaagtgtgccaggcaagagcagggtgacccttggggagatgctgggaccaggaccggaagtgttccctacactctcacctctgccaacctcaaagaatttggttcctctttctcccttcttggctcagcttcctctggttcttttctgggtctcaagcccagtcatgcaaaggagagaaaggaagagaaagcgagagtgtgctcttattatccaaatgccaaactcccagaaaaaagacagctaggattatcagttcaccgctgatctaaccagtgggccagagcatcagggtcacgtgaaacagttatgggcaaagaccatacggcaatcatggtacacagcaggaactggtggccgaaagcccaatcatatgtctgtaatataagtgtagtaggcactcaaaaagtggcatatgttttatgtgtatgtttatgtatgtgtacgtaccacaacaatataatgaatgcactattttaatgcattatatgttataatgtaaaatagcataatgataaaataataataataactattcctttaattaataattttagaatattgaaaatcaagcctagctaggtaagcggtttgccacagaactgagttgcacatcagttttacaacttgctgtgtagctcaggatgactgtgggccatgaccacattaaagctgtttctgtagtactggtgattggacccaggcaagcaccttatcagctggggcacatccccagacctaactctgtgtgtgtgtgtgtgtgtgtgtgtggtggtggtggtggggcgcaaatgtatactaaagtatacacatgggggtcagaagacaacccttgggcgacggtcttcgccttccaccttgtttgagacagtcttcgttctttgccgctgcgtgtgccaggctcactggcctcttaagattctcctgcctccacttcccatctcactgtaggaataccaggattgcatatgtgctgtcatggctggctttgtatgggttcaggggatttgaactcacgtcttcatgatcctgcaacaaacactttattcaccgagccacttcctcagccctctgttgttattattgggctttgtttgtttgtttgtttgtttaatgactataaaacaggttttaaaggatgtgcagtctcattggcccaaatgcccaccatacccttttcttctctggaatgtcaatcagcttctacaaggaacgtcccaatctctgaaccaggaactgtgtgagccagagttatccccataccagtctctggtgtggagaagagagtcttttggaggttgcatgactgttgacctgtgttctcagcagtcctggggttgccctccacactggaaaccgttcaaggtggggcctccccagcaggagctgacctcaggctctgctagatccttgcctgcccagggtcaggctccgagggtttcctgccaggctgcagggaggagtctgggtaagggcctgctggactggaaacttaaccatttgccccctgattaatgtttaacgggcccctgtgctctctgtgtctgggaggggagcccagtccaggctgtgctcgggggagccgatagcatctgtctgtgttcaatgtttcagagatatgctccacgccgggttgggcgcacctgatagacctggaatctacaggggcacctggggccttgccaggacctccaccttccagtgaggcttcctatttcccaggcagacagagctgctatggcatctagccaaatgtcctggctcaggcaggtgactccagcggcagaaccgtgtgccctgaaccctgtgggataaggacctctctggtcattcaagggcttggctacagtacttagccggtggcacacgaacaaaaatggcaagttccacatccaagtgaaaatgttgacagcccccatctggtcccactttggctgagagacgactgtttccagagagaagcggttttctcaagcttgggtctggtgacggtgtacaccccatccacaagaggtacagcagggccggggacagtaaacacctcacgctgtcacagagagattctgagagagcggacagtcctcattctggaccacaccttgcccctgaccagtcacgccttatcacctccacacaaagcctccaatacctgtcaagataaagggagacactgccgactcaaaatgtaaggcatcccgaggagaagaaaactccagccagtaggaaggcaagcctgcctgcctgcctgcctgcctgcctgcctgcctgcctgcctgcctgcctggcttggctctgtgctttctatgcagtccctacagcacctctgggggtcaagggtcatggatgaaagccaaggcttcaaggatgacattagaatgtgacaggattgattaggcttagaatttggcagcctgactctagaattgatgacttcgaatatagaacatgaagtctgatcccagcctcccttccctccctccctccctcccttcccccctctctccttttcttgttcttccttttcccaaacttctacttgtgccaagcaccacatggccagatggttgatgatctacctgggacccgggaacaagctagactggcatgggcttacttgagcagtgacagaacacagggggagagagggatccagggaccttggctgggtgtttgttctgtctgcatcccctgtgcttagccccagtagcaaggtgacactcccctccaggaatcaactaatgctacctgtaacatcttccgtgcctgcacaacacagcagctccccggttgtgccaaaaaatacagatttccaggccctgctatggacctatggaaacaacactcaggtgcgggtcttagaaatctgtgtttatctgaaataaatcttgctgtgtagcccaggctggccctgtactcatagcattctcttgccttggaccctccaagtgcagtgattgcaggcatgcaccaccacacccagcctggctctgtatttctactaagcaatcagggtggcttttccagttgggcaagttgccaaaggagggtagataaggaatgcagagcagaatctggagaacttggccttgagggtctgtaaccaatccttgctacataagtcccttggtcttctactctgtaagatggggacataacccctgtgggactggcctgctacccaagggggcaaaaacaaagacggtcactttccatccctgtgggatgctcagcttttgggtcctccacgggcaggaaccccaaagctcaccatcttccttctcaccctttccagcctgaccggtcgtgaggtcctgacacccttcccaggcctgggtacggcagcagccccggcacaggctggtgctcacctgaagcagtgtgacctactgaagctgtccaggcggcagaagcagctctgcaggcgggagcccggcctggctgagaccctgagggatgctgcacacctggggctgctggaatgtcagttccagttcaggcaggagcgctggaactgcagcctggaggggaggactggcctgctccagagaggtagggaggacttcgggggaggaagaggactggcaggaggttgtgggtggtgagaaggttatgccctggtctcgttgtgctgactactgaggcacagtcccaaatgagaagggacctggggagttagtaatgtctgttgaaggtggcggtttgggagatgagggaaacaaaggaaacacaagggaggaaaggactcagcattcttggaagagatgacagaggaggtgggtggccccagccacctacttagtggtccaaatgtgcacgccaggcagattcctttgtccacacgctcatctgtcactgttcgtcacatctgttgatgtgtcatcccctccttcccacctgactccccctccttccttatccttctccacctctgcctatccatctgctaagcatctgcagaggcccacaaggagccaggcacgacacaaggggctggaggcagaggctgagcacaacccagtcacccttgcaaagtgcatcctctagaaatgaatatgggtcatagcttgtgactccattgtctggtgggaggggtgtggcattctattactgtcacttgttttgggggggtggggggactcggttcctgtagcccaggctggcctggaactaacttgcttcaaatgctctgcaatttgttttactttgagtgctggaatttttcaaggtatgagccatccaccatacctggagacacagtggaaacatcacagtgcggtgatgtctcggggatggccagccccactctaggctggctctccgttgcaggagggtctgagggagagctagcagcctgctctcctttcttttcggccgtcagcttttcagtgccccagatacactgagagtgggaggctaagggaaacgtgtttggggcatctttcaacagtgtgagcacagtggtggtcccagtactgggtagatatcaggcaggaccccccaagacccttctgcctttcagtcatctacagatggtggtagagggcatttgggagacattagacagcttagagatccacagagacaggtcgtccaacttgtcacgaaagcacctgaagtcaagatgactgttcagcctcagcctggcctcgtcccaggtgcccaggtcgctcttttgcataagttactgagattagcagctctgtcctgctgccctctgagagcttaggacatgcttcggtgtaaatctggaggccatttaaggggcagcttttcagcttgggtctgagggacaggtaacaggggaagccttacatagcctttaggaagccgggcctttaggctcacactgcgtcaacctctttgccatacatgccacataactcccgctttcggagggctgcagatggcctctaagctttttttttctcccgcacaggctttaaggagacggccttcctgtatgcagtgtctgcagctgccctcacgcatgcactggccagggcctgcagtgctgggcgcatggagcgctgtacttgtgacgactccccaggcctggagagccggcaggcctggcagtggggtgtgtgtggtgacaatctgaagtacagcaccaagttcctcagcaacttcctggggcccaagagaggaagcaaggacctgagggcgagggctgacgcccacaacacccacgtgggcatcaaggtgagcgaataccctctctagtgcctaaaggatggtgccgaggcagggagatccacgggaggccagtcagtgccctgcacccaacacacagatgaacttcagaccccgttgtgaaccttctctgcgtattcctgagcactaggagcacagaatcctgggtatcatcctggtcgagccaggcttggcatcgtgccatgataggataggaatgtgtttggaaaggcgtctctattccaaggacaaagccagcatcatttgacaacttggatatgacaatgaccaggcttcctccattttgtgaataggagagagaaaggaggcccagaaaaggggaggggcttagatgaggtcacatagccatgagaaataatgagtctctaggtctatggagtgagagggcagggaagggtcggagttccaattcttttaggaaatcaggctgccgtgttcagttgtgcaggctgaacactccagaagaactctgggccaaggggaagagctgttgttggttgagatagggcccacactacccttgcctaggtgtgcactgcttagaggaagggaaaatttttccaactttacacaaagatactttgaggatcccgggtcattgtgaccctggcgctgtcaccttcacgtgggtcttcctgcctctttattctgttgacactccttggcagaactgtcacagcaaacccggcttgcttagacccactgacagacccctactctggctctccctgcaggctgtgaagagcggcctgagaacaacctgcaagtgccatggtgtgtcaggctcctgtgctgttcgtacctgttggaagcagctctccccgtttcgcgagaccggccaggtgctgaagctacgctatgacacggctgtcaaggtgtccagtgccaccaacgaggccttgggtcgtctggagctatgggcccccgctaagccaggtggtcccgccaagggcctagcccctcgtcccggggacctggtctacatggaagattctcccagcttctgccggcccagcaagtactctccgggcacggcaggcagggtgtgttctcgagactccagttgcagcagcctatgctgtgggcgaggctacgacacccagagccgcatggtggttttctcctgccactgtcaggtgcagtggtgctgctacgtggagtgccagcagtgtgcacagcaggagctcgtgtatacctgcaagcgctaggcctccacagcgaatcccgcggaacagcgcgcaagcgcgcacctgtcgacgcacctgccgtgcacaagagtgtgcgactcatctctcttccccaacagatggttggccagcccttctgccttccccgacactcagcaaagagaaagaaagccctgcctcctagtcccaggatcaccaacctgctggaggacttggggccggagaacagactgagaaggggaatctttgaggaccagggtagggcaggaatgatgctgtgcgggaagagagaaacatcctcctatctcaaggccaaaaactgggaggatggggaagagggaggcggagccagctggagtgtggggtcagggcatccatctgggcgtggccgatctcttgtggtcccactctaatagcagagcgctctgggtgctgcatgcctaccctgctcttgtggcttcgtgcactggagacttcgaaatgtttattaggagcaagggaagcactttaggcttgggtggattgagtcgcagagcccatgccctgaagtcttacgtcctggcactcagggctgccaccttgtctccttgtcttgagatcccctgtcccccaaagccattgagctctgctcaacgagacccctaatatgtataagaagggtgcaggagccagtctcctcggtgagactcagataaacataactagggttgagcggggagacagtgaccctttctctttcctttggtccaaggaacctttaatcacagcccagaggtggagagaggcagggtccaaatgcctggaagagatatgacaggctctgtattgagataccactctggagtgtgtcctaccaattcctgtgaccagggacccccaagaaccgaggggcccccatccatgttagtgacacataagaacgagtgactcatgggccacacgtctgcttccaccccctgctctcaaagatgcttgtgcaggcttttttgccattgctaagtctttgccaagtctgcctcctcaatggtcttactcatttactaacgacctgtcacttgggctcccaccagaggaacaaaatgactgctggtgaatcctttggtcatttttaatgcccccatcaaggccctctgtgagaggagaggaagtagtgtacaggtacaggctcacacgtgcacacactcagcctagccaggcacagacatcccaaggagcagtgcggcgtctctccagcccagggcaaagacctcactggggtcacttctggaggctgtgagctactccagggcagggcccaaggccaaccaggaggaagtgacctcctttgggaagcctttggccatgtggctggctgtgctgcaccctcctgtgagcttccttccaccctgaaatctgttggggttactgtctctctaagggagcaggaagcttcggaatcagccggtactcagcactactggccctgccagctccaggaaagagacactgtggcggagaggtccgtggggcagaaggggctaccctttcttcagtgcctccgggcagcatgctgggaagatctttgatggtggaaagccccgaggcggagccaccgtgacctgagacccttctctgggacgactttgccacccacccgcagcttggcaggaggggtaaacagattgggagctgctttctacttccctgatgaagacagatgtgttccttggcaacccaaggcatccttctctatgaccctaatcctgctctggctcgagggtacaaggcaagaatggagcctggcaaaacttggggactagaacacctggacctacagccaaatcacctgtaccctgactctatggccaggagggccaggggtggaggagggttaaagatgaacttgaagttgaggctgaggctgaccaaccattaagactggtgccttaaggcaccctcagtcaggtcctctccctcccttctccattctttctccaaggccccgttccccctaaaatcccaccatagccatgctgggtccccccttcccccacactggaactttaaggaagatattcacagggtatttctgcctacctcatacatgtaattttcaaaaaaaattaatttatatagttaagatatatgggaaagtatttatgttatttatatatcttctctatttcctgggcaccatatggggggttgtgtgtttacccagaagcctctgaggaaacatggctgggtctgtctggggcctcgcagagctggatgcgcatagctgagaggtcacagctcctgtgtctcactgtcttggagctcgggaagcacatgtacctcctgagataaaccccgtgacaccaagcagggccttccttgtgaagtctgtggattctctgcctctggccccagaggcctttctgctctggcccaagggttttgctcataaaggacaaaaagggtgagcagctctggatttgtaaagcactttccatcttcagaaacactcctctcttctctctccctcggttacccccggttccctatgaggtcatgccactgttaccacgttccaggcccagagacggaggcaggttggtcaaagccagtcactctctgaacccagaggttgaggaagagtgcatgctgcgtggaacgctggtcttcccccatggatggcatgctagtttctccagcaagctgagtctcatgtccccaaagacggggacttcctgagaagcctggagagacaagggctccgtggatgtcactcttagggagggtgtcctgcagccctcattgacctccacgactaggctatggtctccagcccctcacagctcgtggataatttgtgtttcttcgcttttgttttttgtcttttcaaagtgactttttccccactggatttctaagtttctctttgaaaatcagttcactggcaaatgggacctgcatcctgacctggctgcctgcatcaggagcgacaccaaacagagtgcgtggggatccccaattggcccagtgtcccccggcccttccttaagtcacacaagctcccgtgtggctttcgtgagcatggagaacctgtcccctggtcttagagaaagccagccattctgccaccctctgtttgtctggcagacagattaccacaccgtggctgtctttctagccaaagcttcctctctcaacacccatgaacgtccatgcttcctgtctgagcactgaggagaaccccagcggagctcattgttcagtgctggaatacccatcccccctcccgttgattatttagggagtgtctgataatgccaggggatactctgggtgctagggcgcagaagtacttaagagcaagtcccagcctcaggggacttatatgccggcgaggagaaagccaacaaaccaataaactatgcactggttatttgtgcttccgttttcattgctgttgtttgggtaatgtgtgtgttcatgtgtgtgcacatgtgtacgtggctgtgggtgtgtgtgcacacgtgtatgtggctgtgggtgtgtgtgcacgtgtacgtggctgtgggtgtgtgtgcacgtggaggttttagaagatgccccttgttttgttttgttttgttttgtttgagacacggtctttcactggcctgggatcagcaagtaggccaggcttgctggcctctccatgcgggaattcccagtgtgtaccattactacaccgtggtttcaggggattgaactcaggtcctgtatgtgcacgataactactttcctgacggggccatctcccagtcttatttgtcctctcttgccttggcttgtggcaatatttttgcccagtagaggctgccacctgacccggctaaggagtaaaggtcgtgaggtgggaaggctcctcagggccaccagcaggcagcagagccagactgaaaacaggggtccttccctcctctcatctccacatctcctcttgggtaagtagggcaggaatgcaccccttgctatgaattctgggtaaatgaggcctagtgtaaagtggttatccaacccaggctgtccatcaaatcagaccaggccaaacatatgagcagaggcccccactctgcggcctgccacatggggagaatgcaagtagtcgaaaacaaagcggtagccttcaggaatctgggacctgaaatgaaaaacaaaaagaacagagatgcaataatggatggggccccttatggtttagctccagagtcccattgcatcctgggggtctggaacaagggaggtagaagcagggagtgggggcagagagttcttatctctgagctcagacacaccctgtgccctgtcccaggtcttcaggccccctagggttctcagggagggaggcagtcctgagggtagccatgtttctccctgtatccccatcctaacatgtttgaggccctgtgctcttgggcatggactccagctggttctgagctagcgacagaaggctccacacacagtaagcaggctttagtttgtccagggctttatcatctgtttcgcttgagccccacctggtacatggcttcatccctcttcacagccaggagaaatgaggctggagtggttaactgttccttctgccaaggtgactcaactttcattgtcttctttgccctttctgccccatgttgccttctgcctcctcacccgacttgagactttcctgctcctacttcagagtccaaaccaggccctgggggctctccattttcagacctttgaatccaaagccgccattctttctacggaactaggagaccagggcttgttgagtgaaatcactagaggaattcctacccaggacatcctccctttaaaaaccaaaacagaactcttagtcttggtggaggagatggctcagtgagtaagagcatgtgctgtgcaagaatgaagacctgaattctaatccctagtacccacttaaaagctggacatagtgccatgtatctaaaaccccagtattgggggaggggtggagataggtagatcctggggttctctgtccaactagcttagctgaaatggtgattctagttcagggagagaccctgtcttaagacaacaagtgatagaggaagacacccaatgtcccgctctggtcccttcactcatatgtgcacatgcctcctgtcttagggttttactgctgtgaacagacaccatgaccaatgcaagtcttataaaggacaacatttaattagagctggcttacaggttcagaggttcagttcattatcatcaagacgggagcatggcagcatccaggcaggtgtggtgcagcagagctgagagttctacatcttcatctgaaggctactagaagactggcttccaggcagctaggatgagggtcttaaagcccacacccatagtgacacacataccccaacaaggccacaccttctaataatgccactccctgggctgagcatatacaaaccatcacattccactccctggcccccataggcttgcccaaacatatgagtctatgggggccatacctaaatataacacaatgcaaaaatacatttagtccaacttcaaaagtccccatagtcaatagcagtctcaacaatgttaaaagtccaaagttcaaagtttcttctgagatttatccaatcacttaactgtaatccccaaagcaaagcagtaagtaacatccctccatggcctctgtatcagctcctgcttcctgatctgcttgagttccagtcctgacttcctttggtgatgaacagcaatgtggaagtgtaagctgaataaacccttccctccccagcctgcttcttggttatgatgtttgtgcaggaatagaaaccctaagatacaccccctcacacaaacacaccaaaataaataaatatacagatgaacatcctttcctgcacttgtgtgcgtgagtgtgtttgcgtgagtgtgtgtgtgtgtgtgtgtgtgtgtgaatgtgtgtgcttattttgtcaacttatttgtaaatttgcagtcaccaagatactccaatattcccagctggcccaggaccagcttcacatctgagagctgtgataccatctaggacgccatctgttctcacacttcttcagatggacctcgagtgtcacttatagcacagctttcctgttcccgcatacactcaagactcgggcactctactctgtgtagggtttccacagccttgtcctctagagtgcactccctgcctgcttgcccctggtgaccctgatcattcctcctcctacgtaccaacactaaagctgcttgcttgtctccatctcccagctgaggtgtgattgtcgcctaacccatggtgcaggcttacttcctccaccacgcttcgtgggtggtgtgtgcctgtccccgtccacgctgtcaggagctgccagcagatgcgctgctcatggctggtgatgctccactcttcactgtgtggcttctgccagagctccccagtaagaagctaccattttccctttgaagttcacaattcttctgagaggaggtggctcaagactgtgggactcttgggatgtctggtaacatttttcaaaaattacattattgtgaacacacacacacagagagagagagagagagggagagagagagagctcagtggttatgagcacttgctttttacagaggacctaactttggctcccagttcccagtactcacatagggacgttcacaacagcctgtaactccagctccagggatccagcctatcttctggcctctgagggtacttgcagcatatggtgcatatacagataagcaggcacacatacacataaataaaaaaatcaattattaaaattacatttattagcctggtggtggtacatgcctttaatcctgccactaggtaggcagaggcagggtaggcagatctctgagttcaaagccagcctggtctataaagccagttccaggataacccgggctatcagagaaaccctgtctcaaaaaaaattatttatttgtatgtgtgtagtggggtggatatatgtggaggccagggagatcatttgcaggagatgagtctctccctctgtcaggtggatctcagggttcaaactcaggccatcggatttgacaggaagtgccgttacccaccgagccacgttgccagccctaatgacatttttacccagtgtgcacaagcgtgcacatgcatatgcatttaggccaggggacaacctcaaatgtcattcttcaggagccattcattcacgttgttgcttgagatggtctcaccaagtaggccaggctggctagtcaccaagtcacagggatcttccagtgccaggaagacaagacacgctgctcctgagaggttaagtgtgggctctggggattgaactcaggtcatcatgtttgcatggtaagcacttggctgacagagccacctccccagcccttagctgaccttttataatgaaggaagggctttccattctccccttctagtgtgacattcttcttcaacgccacagtcaccccgtggggcaaaagaaaaacaaaacaaaacaaaacaaactacccctcccattttacggatttagaaaaccgaggttcagggaggctgaagtactggttgaccgagttgtcagggccaagatttggtcctttctcatgcctgaagttgagcccgttcctctggaatcttcccagtttcttagatgactttgtcctggacggggcaaggagaattcccaaagggatttcagtagcaggtgcagtagatagggagaactgctgggatgctgtgccaaggacacagctccctgaacccaggagccaggctcgctctccatcagcttgtgtcccactcgagagacttcaggctggtgcccatcaccatggtgaccttaaatccttaagctactgagatgcccccaaagtcaacttctttacttctcagcatcctgaagatgcacagagcaatctccccacgtgcttcatcgccagctgggggaaatactgatagtcatttaggggtgtatgcagccatcagatcggacacgcctgttaagagactgaatttagaattttagaaattttccatgcctttgcaaggtcccgcaatgaagaatagggctgaggcttctctctgccttaggaatgcagagatggccgagccaggacctggagcaccagaaagagcatcagggagctgcgaacactcaaggcagttgctagcaccttcctccacccttgcagggctcttttctctgcttgcatacctgcagagtgcaagctggctgccttctgtctctttcctcctcactcacccctcctaaatgcccccggggctgtggaacccatgctcctccccagttctctcaggcccattagtgtgtttatactggagctggcactagggaaccaagccagacccatgccgcccccacccccactagccttcaccttaaagagtggctagttgagaaagaggggctagtcagatgcatggcagacctggcccagtgtccggattcctgccttgctgtctgaacaagtccagggcagccaagggctctggagagtaacggtagccccgggtctcagcacccttcctcggcagcccctcccatggctgacagcctctaatcccagctgtcttcattcagccagccctctgagcccgaggtcacctgacgccgacacattttaattcacaaactgatttctgcttgttggcaacatgtcatttctgaaattgctttctctgcccagaggcgggactgtcagagccgggcaggtgtggtagtggtgccgcccccaccccacccccaccccaagttcaggaaggattaagggggggacatacataagatcctcaagcacggcttctcatgtttctccaagggctggggggccggggatgggggacgctggcgaacggcctcggctcttctccagctggaagactaggggtctgtctagtcttcgggtgaagctattggtgaagctgctgctgtggctacggctgacagtagcaacaagacgtgaccttgagcatgctctgtgcagctgccaagcgccttgcaaggtgccccgctggtacattattgtgtttgcaggttatggtaatcttccaagttggaatcatccctaccacagctgaaaaagctgggcatgatcactcccctgaggtcacacagcaatattgtgtgacaaggctagggttcaaaccagtgatggcaacaaatggccactagaggcgccctagagagcaactgcttctgtctttggttctgctcttggtttaagcatctccagtgaaatgtacctacttccatgaccggcaccatctctgcaccacatttctaatattttaaaatattgccctttacaatcattttaaaataatgataaatttttgtacatgtgtacgtgtgtaatgttttatgaaaatgtgagcatgtacccatgcatgtgagggtcagaggtcaacatcatgtcttcctcagttgccctccatcttattttcccattttcatgtgtgtgaatgagagaggcacacgtgtggatgagcatgcacaagcatccacttgcatgtggaggcccaaacctcattttttgaggcagcgtctcttactgtgcctgggtctctttgcttctgctgaagtgactggccagtgagctcaggaatgctcctgtctctgtctatcttttccatcactcgttctctctctctctctctctctctctctctctctctctctctctctctctctctctnnnnnnnnnnnnnnnnnnnnttctgctcttggtttaagcatctccagtgaaatgtacctacttccatgaccgggcaccatctctgcaccacatttctaatatttttaaatattgccctttacaatcattttaaaataatgataaatttttgtacatgtgtacgtgtgtaatgttttatgaaaaatgtgagcatgtacccatgcatgtgagggtcagaggtcaacatcatgtcttcctcagttgccctccatct

SEQ ID NO: 36 - DNA, 1130 bp, Mus musculus
gagcgcctagtggcgcgaggagatgcgagagtgcaccggccgcctgcaccatgcgccccgcgcccgcgctggccctggctgcgctctgcctgctggtgctgcctgccgctgccgccgccgccgcctacttcggcctgaccggtcgtgaggtcctgacacccttcccaggcctgggtacggcagcagccccggcacaggctggtgctcacctgaagcagtgtgacctactgaagctgtccaggcggcagaagcagctctgcaggcgggagcccggcctggctgagaccctgagggatgctgcacacctggggctgctggaatgtcagttccagttcaggcaggagcgctggaactgcagcctggaggggaggactggcctgctccagagaggctttaaggagacggccttcctgtatgcagtgtctgcagctgccctcacgcatgcactggccagggcctgcagtgctgggcgcatggagcgctgtacttgtgacgactccccaggcctggagagccggcaggcctggcagtggggtgtgtgtggtgacaatctgaagtacagcaccaagttcctcagcaacttcctggggcccaagagaggaagcaaggacctgagggcgagggctgacgcccacaacacccacgtgggcatcaaggctgtgaagagcggcctgagaacaacctgcaagtgccatggtgtgtcaggctcctgtgctgttcgtacctgttggaagcagctctccccgtttcgcgagaccggccaggtgctgaagctacgctatgacacggctgtcaaggtgtccagtgccaccaacgaggccttgggtcgtctggagctatgggcccccgctaagccaggtggtcccgccaagggcctagcccctcgtcccggggacctggtctacatggaagattctcccagcttctgccggcccagcaagtactctccgggcacggcaggcagggtgtgttctcgagactccagttgcagcagcctatgctgtgggcgaggctacgacacccagagccgcatggtggttttctcctgccactgtcaggtgcagtggtgctgctacgtggagtgccagcagtgtgcacagcaggagctcgtgtatacctgcaagcgctag

SEQ ID NO: 37 - protein, 355 aa, Mus musculus
MRPAPALAALCLLVLPAAAAAAAYFGLTGREVLTPFPGLGTAAAPAQAGAHLKQCDLLKLSRRQKQLCRREPGLAETLRDAAHLGLLECQFQFRQERWNCSLEGRTGLLQRGFKETAFLYAVSAAALTHARACSAGRMERCTCDDSPGLESRQAWQWGVCGDNLKYSTKFLSNFLGPKRGSKDLRARADAHNTHVGIKAVKSGLRTTCKCHGVSGSCAVRTCWKQLSPFRETGQVLKLRYDTAVKVSSATNEALGRLELWAPAKPGGPAKGLAPRPGDLVYMEDSPSFCRPSKYSPGTAGRVCSRDSSCSSLCCGRGYDTQSRMVVFSCHCQVQWCCYVECQQCAQQELVYTCKR

SEQ ID NO: 38 - DNA, 45944 bp, Homo sapiens
  misc_feature (1)...(45944): n = A,T,C or G
ctgggggctgcaatgccagaggattccttgaggagaaggggctggtggggcgggtaggggctggccgggagcaggaccgggaggaactggaccctctggactggggagtgcggggtagatgaaggcagaggagatggaggttctgcagtgtgaggcaggcggacagggaagcctgcatccagctgagagaccttgagcaaccacgtcctcctctgagctccgcgtttgccgtgtgcaaagtgaaggggtaggccgaccccgcagggcccttcttgcgctcctctgcggtgtgtgggggggtctctggtccgcgagaggacagtccctgccgcgccgagcgtcctccagcgtccgcggccgccgcgagcagcgctgaccggcagggggcgctcctgcagaaggctggccgcggtggcgccctcggcggggcctgggctggcctggggacccgggaggcctccccctccatccctccaggtcctctcccaccacttgccttctcacaccgccccttcccactctatgctctgggattaaaggcttgggaagttgctggtatttaggtccttgggcaggccacttcgcctctctgtgcctcagtttcttcaggcgcaaactgggttgtgtgaggaagagatgagttattggtcaggagagccttccagccacaggtgaggtagatatgccgctgctgcacaccccaatatcattcctagggcaggggctgctgctctacaacctcagggttacagttagctttaaatctttatttatttggttgttttttcagacagggtctccctctgtcgcccaggctggagtgcagtggcgcgatcacggctcactgcagcctcaaactcctgggttcaaaccatcctcctgcctcagcctcccgagtagctcgaaccacaggtgcataccaccatgcccagctattaattttttttgtagagatgggatcttgctttggtgcccagagctggtctcgaactcctgggctcaagtgatcctcccatctcagtctcccaaagtgctgggattacaggcatgagccaccgtaccctgctttaaacttttattcaaagtccttttgtgcaaagatagaaataattcctggatcctacagagtgcctggcatgatgagtgatgctcaaaacgtagctgtggaatgattagttttttgaaaccatccagacagaagctatgagaaaatcagacagtgcacctcttctgaatcacactggaagatgtccacattcatcttcacatttctcaccactgttctgtgaggaaggtggacagggagtgttgtatccattttatggatgaagaaaccgaggtcgcagaggaagccagagacaagattttaagttaggacccagggttctctccatgcaacctcaggtaaattatcctgttgttgctagtgactcctattggagacatgtggtattgcaaccaggccacattagacactgaaggcacctcatgaggaagaaggtgggcacatcctgggtgccaagcccagagagggagaaactagggtagatattaatatcggagctgggggaatgaaaatgatatttcagaatcaacaacagattggaaaggcttaactagtttaaaacacattccctattcttaagtccccaacactttttcaacctcctctcactccaaagtagaacttaatgtagcaaaggtatgctttgtagggtgaacccttataattataatgacaaccagtgggaaaacttggtttcctttcaaacgtttgtgtgactaattaggagggactattccattcgttaaagtgaagaaagaaggactgaaaaaaaaaatcactctgcaaaatccagctcaaacattgctgcatctcagttgccattgtcttagctacctcttccctggaacaatgaattgattgtcttctttcctgggttcctgcctcatttggtactttcttctctttactgctgcacagtcgttaaatatgtgtctttggtgccagctccctgggttctaatcccggttctaagcttactagctggccagttacttgacttctctgtgcccatttcctcatttgtaaaatgctgtgagcattaaatgggttaacagttttataggacttagaacaatacctggtgtaatgtaagtgctcaataactagtttacacttatatagatatgtcagaatgctctctgtatttatttatgtgtctttcccaacaaactgtgtgctcctcaaggacaagaactgacttcatcatctcctattccagggtttagcaccagatgcttattcaaagtatgttaaactgaatattatgtattcatactttattattattttttctaagacaaggttcttgctctgttgcagttcttgctctggagtgcagtggtggcatcatggctcattgcagttgcaacttcccatgctcaagaaatcctcccatctcagcctccagggtagctgggactacaggcatgtgccacaatgcctggctaattttttttttcttttttgtattagcagggtctcactgtgttgctgaggctggtcttgaactcctggcctcaagcaatcctcctgcctcagtctcccagaatgctaggattataggcatgagccactgtatccagcctatactttatataaagtagaaaatatgcagtgaggtggagttagccaccttttttttttttttttttttgataagttaagcctcagcttactgcttcccagagataaaccaaggttcgagtctctcctttgtttaaagaaaaacatctggctgggccactgcagtcctaccatgagttcaggaaaacgtgctatggtccaactgtctaccagtcaggacacagttaatgagcacttcctgtaaacttatttgtacctgcagttctgataatatgacctggaggaaatggtgtggtggtggccgatttctaaaactaactgcaaaggattgcattcctctaggcacctatgaacttcaagatgggacccctttcctctcgtccttctttttagagagtttagagagcaagaacttactcagatgaaaacaaactaaaagatgttgagaatgcctctgtgcagacccaaatctataggatgttatttatagtaaattatggcatatttttaaacttctagtccctaagaaagttgttttcttgcctccctccttcccttccttccttccttccttcctctttcttctttctttcttttttattttttggagatggagttttgctcttgttgccccagggctggagtgcaatggtgggatctctgctcactgcaacctccgcctcccagctgcaagcaactctcctgcctcagccttctaagtagctgggactaccggcatgcaccaccacacctggctaattttttgtatttttagtagagatggggtttcaccatgttgaccagtctggtctggaactcctgacctcaggtgatccactcgcctcggcctcccaaagtgcttggattacaggcgtaagccacagtgcctggtctccttcctccttcttttgagcagtatccatagctatgtcctgtgtggaatgcctttctgttgtaaaacaccccaacgtagagtctttcactagtgctttgcccataggggacttcacggtggttgaagacagaatgccctgctgctccgtgccacctgcccagccatctcctagtctctaggtcagctcactgtattctatgctcctggaagtggtaaccagggctggggtgggggttatattcacggtgagcccagtgcccaaacagagcttggacatatatgtcacctgacatacatgagtcgacttacagggacaatggagtgagttatctgaattttttttttttttttttttttgagacagagtcttgctctgtcaccctggccagagtgcagtggcacaatctcggctcactgcaacctctgcctcctgggttcaaacgattttcctgccttggcctcccgagtagctggggactacaggtgcccgccaccacacctggctaacttttgtatttttagtagagatgggtttcaccatcttggccaggctgctctcaaactcctgaccttgtgatccaaccacctcggcctcccaaagtgcagggattacacgtgtgagccactgtgctggctttttttttttttttttttttttgagatcaaatctcgttctgtcctccaggctagagtgcagtggtgtggtctcctttcactgcaaactccgcctcctgagttcaagcgattctcctgcttcagccatctgagtagctgggattacaggcacctgccaccaggcccagctaatttttgtattttcagcagagatggggttttgccatgttggccagggtggtcttgaactcctgatctcaggtgctccacccacttcagcctcccaaagttctgggattataggtgtgaaccaccgtgcccggccatgttatctgaaattgagagttctcctccaggtcactacttacttacctataactactagacagaactggactgctcaaagcactcctgctagtttcaaccgtttcagtacagatggctcatcctgtctctcatgaacattataaaatcagaggcagggtttgtagccatcaataagtcaggtctgaccttccacagtccaatgtttattcattcagttattcattcattaattcagttatttaacaatgtttttactgtgggctgaaactcagtaccactatgggaggaagtgtgggatagaaaagaaacaggggacagggtctcagatcttgaggtgtctgcagtctacacatagcagggatgcctaatctcccaaactcaaggacagtgtatatcaacataggcactggcacaaagtacagttgtgccaataaaggttgtagaaccaatgtggtgagtgagcagaggcaggaattgtcagtcaaggtggggttccagctgcccttggccacagaagcatggctgggtggggggccaccaaagggctgcttctctgcattcagcctgccttggctgaactcaaagatgctgctggataaagggctggagaatggccttgaataggcaaggggcaagagaaggtgggtcccacaccgtcctcacaacacaattcaaagagttctgtgaggaagaagagggagggagggaggaacagaagtgagaaggcctcgaactggaagtgccatggggagtggtgagctctgccagctctggagtgagcttcccaagataggacaggggcccttcccgcagaaggacagatgagtgaaggtcacagaggactccagtccagaaatactgccctgcccctcccaaatacctttcctgcaaatgcttaaagttccaccattggagatgtattgttatgtatttttctcctccccactttcagtaatttttttcattataaatgtcaaacattcttgtcatagaaaactaggaaaatgcaaggaagataaaaacatttcttaccccacactcccaacctccaaggcagcccctattaacattttggtgtccttctctgcccccttttttgtcattttcaggcatggctgtgagttccctggaggggattctgaagcccactttccccacttagcttcagtcctatttcagtctggtgttccagaaaaatcaagtcttccatccccgagagccagtgagttctatgaccttgaggaagtcattcatctttctggactttagtgccctcatctgtataatggggacaatcatggcccacatgctacctcacagtgctccagagtcaatgctagtgcaatgttgcaagggcattgccaatacagttcaagtatgtggggctaggactgatgggagtggtcaggactcagccagtcatcataaggctatgacaagaaggccaggtcacctggaggatggggaaggacagggagagggacaggtgagcccacacccacaccagtcctgtccaggctccccaggaccagccctcctgggcagctgtgtgtcaggtcagcatgggcaccttccctcggagctgctggggcatcatctgttccacttcctgttgggtccagagttcatttccagtgcagtttgagggagattagaggagagagccagcctgggaagccgcatttccacttgggaggcacaggagatatggagccaaccaaaggcggatggttcctgagggtttgtttcaggcagggtgggctggcctgggggcaggtgccgggaagaggaaggagaggtctgcagacatcctggagctagatttgatgtggccatagcaaagctttcagcctcatcatgtttgtgatttccaaagtgtgtgtgtgtgtgtgtgtgtgtgtgtgtgtgcacgtgcatgtgtgcacaagaggaggagagggctccagccctgagcgctggctgccttgggctggttaatggagacaggtagctgcatgtggatatccaagaatgcttctcttgcatacctgtgtgaacgtgtggacccaggaccagctgtggggctgcccaggaatgtagacacccatgggggaacagtgggggtctgtgtgtcaccaaatgcctggacttgggctgtagtgtgtgtgccccatggagcccgtgtccgagcccaggaaggagtgcttccgtcaccacacatgtgtttgtatgatactttacatgtttactgccataaaaaggccacaaaccagggttataagctgaaaacaacacttgtttcctgagtacctactatgtgctgggacctgtgccagactctggagacacagagagaagtgaaactcaggccagcccttcaggagcccacagggcagagggaaggtggcagagcaacaaatcatttatggcacaggctgtaggtcccaagggctgctcttcatgtccttcctcagggatcctataatatcacaattgcagggatgatctgttttcactgccgtctccccctccaggctataagccccttggggatggacacttaggaggtacacgatgctctgtaaggatgtataatgcaaaggtgtctgtgagtcaggctgtgcctgggcagttctgagccagccatggccaatcatgagccatagccagtactgacagtaccgctgggctagggctgggctcaattcctgcctccactacagctggcccacctacacctgctacgtcagctctcccagcctctgttttttcatctgtgcaatggagttatgattgtcccagcctcccagagggcttgaggctttagtgagattgtgagccaggcccggcacatgtgtgcacgtgcacacacacacacacacagagcttggtacacaggagctgctgtggaattattattattagcaagaaggagctattatctgggcagttctatgcagccttattggccaaaaagacagaagcagaactctgaagcctccatgggcaagctggaaggcaccccagcagacagaaacctggtacagttctaacatcaggaggagggaacccaagggtggggccacgccattggctggcaaggattcaagagcatccatctaaatattttcctcgtgtttctcactctccagccactgatgtctccatcgagtcttgggtgcttcttccagtctttgattcataggcttacccatcagacatcaacatgtaactttcatgaaattttgaaaaggtgtcactttgggagaatgtgccctgccttctccatgcacaagcatgcttatgtgtgcttaggggcatgagaacaggaggagcagctgggcagcctgagctgaacccactccatcctcacctgcctagggggtgtggctggggcctggtggggtctgtctgccaccccagtccatggctcttccttctctctgactcacactggtccagctcaggcccctcatcctctagcttctgtgatcgtggttcaaaatcttaccagtgatatgctggagctgggtccagctggcctgcagggctagctgtgcacatctcttcctaactccagtgatcagaaacgatgccacattggtggcatgaagtcagccatgatgggaatatttaaggcacagagatcaacagatgatacaaatcagaccaccatcaaccctccttgagaaccagttgtaaacaccatcacaccccagtcctgcctgcaggtataacgatcactgatattaggtgccggcacctgctaggcatttaatatctttttttttttgttttgagatggagtcccattctattgcccaggccagagtgcaatggcgtgatttcggctcactgcaacctccacctcccaggttcaagcgattctcttgtctcagcctcctgagtagctgggattacaggcatgcactgccacacccggctaatgtctttgtatttttaggagagacagggttttgccatgttggccaggctggtctcgaattcctgacctcaggtgatcctctcacctcggcctcccaaagtgctgggattacaggcatgagccaacgtgcctggccagcatttaacatcttacctgcacaaaaatcctgttagatatttctcatcatccatatttcatatggggctcataacttacatgatttgactccaggtctctgcacattacattgggccatgtggcctcaataagtagaaccatgggatttgatagggctggcagagctgttaggaatcatcagatcatgtaatcactgcgctcatttgacagagaaactgagctcaaagaggctcaaagaggtgggggcttcctctgttaatgccacctaacacggtagccaccatcttcccaacacctccctcaacacctctctcagccccctaccatgctggtgtccactgaaaagccaaggtcgcggtcacttgatgttccctatgcatggctgattttttggaaactttacatgcagatcttgacattcattgcaagttatattttgttttgcttgatttgaccccgtgttcgagactctcaaaaacattttaaatctcacttgggtcattggttgtatgtctcctttctagacaggtaccacgcgccgctttgatctctgcaccttcgcagcagaaattggggttaaactttaaaaaataataagcaaaacagaactttggggcccaacacttgaagttcccaccctatctaccagagattctggcatctacacaccttggaaagtgggtccctcctcccgcagggctctgtctgccccactgtccactttggatttctgcgctggggaacatcagcagcattttgtcaaaagcccacggaggcccacgctgcgcgcctcgccggtaacagtcactctcccgtttaaaaacagagcgccctttcctctctcccctctgcccaagactctttgcctggcaacagggtcccctgagccattggacatgcatttcccccgcttccagagagcggttctgcaccaggacccggccctgccctgagtctgcgggctgcggcgaagagaccgcacttgcccggcaggagggcggacaatgacccgggttttccaccgactccagatgcgtccctcctcctacccctccaccttctctacctcggagaagccattgcgcttgcctccgccccatcccggagaggcagaatctcctccgtccccgcctcgtaccctcctccccgcctctccaggcccggggggcttcacgttcagccaccgcgaccccgggcgggcgcggcgccaggtgagcgctcacctggggccggagggcggggcaatgggggaggggcgggggcggtccaggggcggctgccccacccgcgacggggcggggcgagggcggtggggccaatggggcggggggctcgccgcccggggctggggagcctcccaatctcctcctttcccagcgccgcctgccccgccccacccgggtttaaagtcccgcgggcgggtggtggcggagctgcgagcttgagcggcgcgaggagatgctagagggcgcagcgccgccagcaccatgcgccccccgcccgcgctggccctggccgggctctgcctgctggcgctgcccgccgccgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagtcggagttcgcgccctgagttcggtctccagcttccccggctccgaatccatcgccctgttcagtgtccgagtctctggtcgccccccagccgccgctctcctcatcccgccgggtctcggactctgcgcacgcctcggaccctggccccgtccgccccggccccgcccgttcaggcgtcagtcccgctctctgatgccctctcgggatcctcacgccggtgccctgtctgccgccatcctggcctccggcgagccgtccttgcctcggactccttccccaccctccgccttcgccctgcggagcggagaccgagagggctgggtggatgggtgggacgggctgttcccggtctcggggcagaggatcgtgcgcgtccagggagaatgggggaaacctcggacggtgagagcgccagctggagacgcaggaaggaaccgtgcgctggggaaatgcgaccacatctcagacctggcatggggtgatttctcaggagaacactggaaagagtgagagggcccagtgtgtgtgtgtgtgtgtgtgtgtgtgtgtgtgtgtgtgtgtgtgtgtgtgtacatggttggaaaaggaggatcacagtggggggtgacacctgggggacagtggggtaggtgacactggggagagagccggacaggaactatgtggggaatgtttggagcaaaagttatagggcaattgtttccagtcccttcttctctgaccctgaattgcagggatttggtgagggatgggggcgggtatcatgggtaagaaggcaccttcccaccatccacccaaagccaactccaatatgtacagcctgttactttaagccttgcctccttttaaaatcttcaccccaaatcaataggaggcttacagtctgagtatatacagcaaaggcaagaaaacaccaagcaagtgacctgctagaggctgctttgaagaagtagccagggagaggtatgtaaaggtctgagaagttctgcacaggttggagtaagggctgtgggctaatttccaggtcatgacccctggtggaaacatgtctgggctgtggaggagggtatcatcccagaccctagctctgggcttagcttgctaatgatatgggaagaccactcagtctctgggcctcactttctccttttgtacaaagaaggggttgaacttgatatgactgatccttttgcgatccaccccaacagcagtgcacaacttgtttgtttccgaagatttcaggcttgaaggaatggttgttccctcggcaggcaggatgtcatcatcactagggcacagactctggggtcagtcttgccacttgctaggtgtgctcttggccaagtcacttaacttaacctctctgtctctcagtctctcaatctgtaaaatgaagattatactgcctattttataagaagattgagctagtacatgtaaagcacttaggacagtgtctagcatgcagtaagtgctcaactaatgctagtgactttttttttttttttttttttttttttaagacggagtctccctctgtcacccaggctggagtgcagtgatgtgatcttgggtcactgcaacctccatctcatgggttcaagcgattctcctgcctcagcctcctgaatagctgggactataggcgcgtgccaccatgcccagctaatttttgtatttttagtagagacagtgtttcaccatgttggccaggctggtctcgaactcctgatctcaatctgcccaactcagcctcccaaagtgctgggattacaggcatgagccaccaggcctggctagtttttttcattaaggaaaccagttatagaatcttgatgtcctggccctaacagttttctgagctggaatggaaagggatgggacaaatggtacctatatcctcttacacactggctcatttccacgattcatttgtttgcttggtttttatggttagagatggggcaagagtcaggtgagatgagaggagaggggttccaggaggaccaccctagctgctgtattggaagggaaaggtgttctcagcagtgcatggggttagaattttgagggaactgagcatggagcagccttgaaaatgacatgtgagatggtcaaataggcctgggttagggctgagagggatgagtatcggagccacctcttccaggtcaggagcccagctggaaagagctgacaaaagacacaaaagccaccaccaccccaatctggggagcaggacagatgctcagagaatcagctaaaactggggcctcatgatgttaagtgtttggtctcagggaacagacaggattcagcctgagctctcagttaagaaaccctctggtgactcagaccaggtttcccagcttcccatctgcattcgctgtctgggaggaatctggtatcagtcatctacactgtagtgggaaagtgaggcaaagcgcttcttcctccgcagtcatttgcatttgattataacacaaagtgctttggcatcctgataagagaatatgcaaacatcaggagggcaggtgaggccgatcttcttgggctctttgaaatcatagaatcgtagacttcagagttggaagtgaccccagaaggatctctggtccaaaactcactgcttcaagcaggatgtattattatcccaatttttcagatgaggcaacccccaaaccccaaaccacagtgagccagctgttggttctgctgcttttgagtgagcctagagcctaattctgttaatggtgataaaaaaaaacataactagtattgcagtttacaaatctcttttttctttttttgagatggagtcttgctgtgtcacccaggctgggtgcagtgtcatgatctcggctcactgcaaccgccacctcctgggctcaagcaattttcctgcctcagctttccgagagctaggattactggtgccccccatcacaccccactaatttttgtatttttaatagagatggggtttcaccatgttgggcaggctggtcttgaactcctgacctcaggtgatccacttgcctgggcctcctaaagtgctgggattacaggcatgagctaccatgcccagcccatcactttctcatacagccatctctctcatctgatcctcagagccatttctccagagccatgtaggatgggtgtaaatagttcccacaaggaatctgaaggtcagaaaggttcagtcagtcacccagtgttacacagtgaatcggtgggggaggttgaatagaaaccctgcttccagtctgggcccttcaacctacaggaacagcctccagtgctaagacagtatgattcccccagggcagcagtggctgcagagaggccgaagggggtgagggtggagggagcctcccttccctgcttaattgactcttttagactctcttggctgtagtgagatggataaggccgcacattcttttctgtcctcagtagtgagacgggttgcactgacccctgctagactgtcagtttggctcacagaacagcatgatggcagtgggacaggaggcggaccagaggtgagggtccaagctagtcctggctctgggacactctctgtgttgtccctgatcaagtcactcatctccaaggtcagtagcacctggaggtgctaaggttccctaatgctaacagggctggtcctggctctggaagtctaggattgctgaagagtttttattttggctttgaatgcctaggaattccacaaatgttaacttctgtgatgttgtataaatgaaaatgcactgcattatgtgatgagctgggcacaagacaggcccagttacccaatccagtctatttatttatttatttagagacggagtctcgctctgtcacccaggctagagtgcaatggtgtgatctcggctcattgcaacctccacctcccaagttcaacagattctcctgcctcagcttccccagtagctgagattgcaggcatgtgccaccatgcctggctaatttttgtatttttagtagagaccatgttgatcaggctggtctggaactcctgacctcaaatgatccacccacctcagcctcccaaactgctgggcttataggtgtgtgccaccatgcccggcccccagtccagtctgtaagttatccgagtggctttgtaactagaaatagtttctgtggatgcaagtttttaaatcataattaactttggtgatgtttcttcagtgtgtgacctctgcactggttgagtttctttcctctctagggatagtacagagaagtttatgaaagcccaagacagtgaatcccagctttgcctgttgctaactgtgtgactttagacaaatgtcttaaccttgctgagctttgggttatgagaatacctatctgagaggtgagggtgaggcttaattgaaacaatgaatgaaagggctggatagggtgtctggcacatatgtgctaagtgctcagtccaggctcactctcagtggatgctggggttctaaacatcatcccaggtggtggaagtgtcattactataattccattggagaaacaaaacataatctttattttccccccaaatcgttgttatatacaatgaaatgcatgctttttctttcttttttttttttttgagatggagtctcactatgtcgcccaggctggaatgcagtggtgcaatctcggctcactgcagcctccgcctcccggttcaagtgattctcctgcctcagcctctcaagtagatgggatgacaagtgtgcgccaccatgcccagctaatttttgtatttttagtgaagacacggtttcaccatgttggccaagcaggtctcaaactcctgacctcaggtgatccacccacctcagcctcccaaagtgctagaattatgggcgtgcaccaccacggccagccaatgcatgcattttaaattgcacagtttgggttttaacaaattatacacctgtgtaacacatttgtggtgactccaatgactacatagaacatttctaccatcctaaaggatcctttgttcctctttgcaatcaaccctctcccaccagcccatggctactccacttctccgctttcagtcactatgtgttagttttgcctattctggaagtttatatcatgaaattgtgagtatatagcctcttttgcttggattattttgctcagcataaagcttttgagattcatccatgtcgttgaatatagcaatagcgaattcctttttatggctgagtattcctttgtatggctataccacaaattatttatccattccccacttgatagacatttgggttattttggnnnnnnnnnnnnnnnnnnnnnnnnnnnatggtgaaaacccatctctactaaaattacaagaatcagctgggtgtgatggtggtggtgcatgcctctaatcccagctactcaggaggctgaggcaggagaatcacttgaacccaggaggcagaggttgcagtgagccaagactgtgccactgcttttccagcctgggcaacagagcaagactctgtctcaaaaaaaaaaaaaaaaaaaaaaagatatttgggttatttgcagttttggactattccaaataaagctggtataaacatccatgtacatctctttttgtgggtgtatgttttcatttctcttggataactgtctaggagtggattgttggatcagatggttgatatatgcataacttatagaattggcatttttcagagtggttttaccattttacacagtaatgtatgagagttccagttgctccatattctatggtcagctatcatcagttttaacttgtggctattttcgtaagtatgtagtagtatctcattgtggttttaatttgtatttccccattgatgaatggtgtgttgaacattttcccatgtgtatattggtcatttgaatatcatttcattgggttatttgtcttcttattgaattgtaagagttctttatgtattttgttgttgttgttgttgctgttgtttgagatggagtctcactctgtatcccaggctggagtacaatggcatgatcttggctaactgcaacctccacctcctggattcaagcaattcttgtggctcagcctcccaagtagctgggactacaggcatgcgccaccatgctcggctaatttttgtatttgtagtagagataaggtttcatcatgttggcctggctggtcttgaactcctgacctcatgtgatccacccacctcggcctcccaaagtgctgggattacaggcgtgagccacttggcctaagagttctttatatattttggatacaagtctttgtcacaagtactggtaatattttattcctgcccgtgacttgccgtttcattttcttattgatgtcttatgaagaacagatgtttttaattttgatgaagtccagtgtatcaaccttttcttgtatggtttgtgctttgttggtgttctacccaagaaatctctgcctacccaaaagttgcaaagatttcttcctacgttttctcctttttattttattttattttattttattttattttttggagaaatgatatctttcggtcctccaggctagagttgcttctgctgcttttgagtaagcctggagcctaattctgttggtggtgataaaaacataataactagtattgcagtttacaaatcactttctcatacagccccttctctcacctgatcctcagggccattcctccagaaccatgtaggatgggtgtaaatagttctcacaaggaaactaaatgtgttacacaatcacagctcactacagcctcgaccttctggactcaagtgatcctcctgccttagcctcctgagtagctggggccacaggcatgcgccatcacgcccagctaattttttatttttttgtagagatggggttttgctatgttgctcaggctggtctcaaactcctgggctcaagcaattctcctgcctcggcctctcaaactgctgggattattggcatgagccacagctagaaacttataattttagctttttttttttttttttgacagaatttcactcttgttacccaggctggagtgcagtggcatgatctcggctcactgcaacctccacctcccgggttcaagtgattcttctgactcagcctcctgagtagctggaagtacagatgcccgccactgtgcctagctaattttgtatttttagtggagatggggtttcaccatgttgggcaggctggtcttgaactcctgacctcaggtgatccacctgcctcggcctcccaaagtgctggcattacaggcgtgagccaccacacccagccaatcttagcttttacccttaagtctatggttcattttgagttaactagtgtgtacagcatggagtaaggggcaagcttattattttgcatatgaatgtccacgtgtttcagtgccatttgttgaaatgatgatgttttctccactgtcatctttgttgctcatcaattgattcaatatgtgtgggcctatttctggacactctactctgtttcatttatctatatgcctatccttatgccaatactatacagccttgattacagtagctttaaaaaaaatttttccccaataagccttttatattcctagattactatagctttatgttaagtcttgaaactaagtactataagttctctaactgtgcactattttttcgaaattgcatgggctattcagggtcattgtatttcggcatagattttagtagtatctcgtcaatatccacatgaaagcctcctaggattttgactgggattgcattgaatctatacatcagttcatggaagattgacgttctaacaatattgagtctgctgatttgcacacaggccatatctttctatttagagcttttgtaatttctctcagcagtgttttctagttttcagtgtgcaggcattgaaaatttaaaaaaagaaattcttccaatgtgctctatgtatttagatagtattgtttttatttttaataaaaacacatttttagaaattgaattggggcctgagaaaaacatagttggagggaaggaaaggtaaaagaaattttactgctttgggggtggtggactgaaagccaaacatcgctgataagaatcactgtgttttgggaaggaatttaggccagcttgtctctggctgagctgtaacccctgaggagctgggctccagagttgggctgagagtcatcctagcctcttcagtggatgatggtggactttctgtggctgaggacgggaaggaggagaggagggaagcggggccggcagactcccgggctggaatctcctaaggaagagaggtcctggtgcctttgggattatgtgctcaggtggaagttgggctcaggaggaggtgggccaggtgctgtgagggtgactcccatcctggcatcagcatgagcaggatcggacatggcccaaggccctgttatagtgtaaggggcactgggcttggggtcacacagatcagagttcaaatctccatctaccacttactgactgacccagggcaagtcagataaccattctgaccccagttttctcatctgtaaaatgggataatcttgatctcttaggcttgttgtaagagttaaatgaatgtatatataggtattcaaatgctatctctatataaggattccaagaaatctagtgatctgccttacagcgtcccacgtttagaagagtctttggtggtgacatctgttccttcttctctgtgcctgtatcccagccactgtacaattcagaacaaacccagccttttctgtgctcagcactttatgtgcattacttcacctcacattgtggcaacccaggaggtaggtgctgatataattctcatttattttaaaatttcactttttttttatttttagagagataggttcctgctctgtcacccagactagagtgcaatggcttgatcatagctcatggcagccttgaactcctgacctcaagcagtcctcctgcctctgccttctgagtagctgggattacaggcccaaggcatcatacctggccagttatcctcatttataggtgtgcgtgttggggggaaactgtcagaatccaagccaacctcttcatctctgccatatgttggcagtggaaccccaactggaggcctgtccccttagggcagctctgtccctctgagccccgaccctgtggcccaggccctgcacttggtgcatgtcctgggcatctgttgtcctgtgtgtctcaaactcttggctcattagctaatttttcaggtgctcaggtcttcaattcacttgtagtttcctttagtagagacctcggggccctgctgttggctgagtcccacagtctctagcagtgctccctggtctgcagtgaatatcttggtgggcagcgtcctctccctttcactggcccttcctttcccctggaatctccctctgtgccctgtcccattcactccttcatcttctgcctccatgggctctctggggcacatactacctcacctaggcctggccaactgggagccatggcctggcttctgtcaggataggaactggacacaaagcagagagcagagacttatccccatcggactccagaaatcagccacacccaccacctcatggcatgctggtagcagcagacatgagctgggggcatagggtggcctcttctacacccaagcccctcattggagagatgaaggctgaagaggagggtgaagagtcttagagccagaaagaccaactaccaagctctggtcagtcctggaaacttccaagaggctggttttagggcaagaccaaagggtttgtttttcctggtgttacaatccctttgaggccagatgctgtcagaattcaacatttctctttgaattttagaaaagtaggccgggtgcagtggctcatgcctgtaatcccagcactttgggaggctgaggcaggtggatcacctgaggtcaggagtttgagaacagcctggccaacatggtgaaaccccatctctactaaaaatacaaaaatagctgggcgtggtgacagccgcttgtaatcccagctacttgggaggctgaggcaagagaattgcttgaacctgggaggcggagtttgcagtgagccgagattgtgccattgcactgaagcctgggcaacaagagtgaaactccgtctcaaaaaaaaaaaaaaaagaaaaagaaaaagaaaagggaaagaaaagtaatataggaggtaggggaggcagaacaaataaacttaaaaaataaaaattaaaaaattaaaagtacagaaaggtaacgtatcgtatattccatggctaacagcacctctagcaagatctggggcagcacctgtaatcagactctattaattttgcaggtagacatctacaggttgggataaacaaagcccataatattctccctggtttgggtcagggcttgctaccgtatgagttcaccacaattgttaaaaaaacttgtagttttctgagtttcctggaatttggaattgtggataagggtttgtgaatctgtggcaaattctgagcccaagtcactgcgagaggttgtgcaagctgagttttttttgtttgttttgttttgtttttttgagacggagtcttgctctgtcgcccaggctggagtgcagtggcaggatcttagctcactacaacctctgcctcccaggttcaagggattctcctgcctcagcctcccgagtagctaggacaacaggcgtctaccaccacacctggctaattttttgtatctttagtagagatggggttttaccatgttggccaggctggtctcaaactcctgatctcaagtgatccgcccgcctcggcctcccagagtgctgggattacaagcgtgagccactgtgtaccaggcctaagctgagttttaaacaaagactcaggccagttgcttggctggtcctcgctgggtgtcaccaggctacccaagcacagatcttccccaggaactgaggttcagagggaacgggcctggctctcagaccccaaggtacagggccccacaggggctgaggaccatggcgggatggccccgagatctggcactggggagagcatacgccagcaatcagtcgtnnnnnnnnnnnnnnnnnnnncttttgacaaaatgctgctgatgttccccagcgcagaaatccaaagtggacagtggggcagacagagccctgcgggaggagggacccactttccaaggtgtgtagatgccagaatctctggtagatagggtgggaacttcaagtgttgggccccaaagttctgttttgcttattattttttaaagtttaaccccaatttctgctgcgaaggtgcagagatcaaagcggcgggtggtacctgtctagaaaggagacatacaaccaatgacccaagtgagatttaaaatgtttttgagagtctcgaacactgggtcaaatcaagcaaaacaaaatataacttgcaatgaatgtcaagatctgcatgtaaagtttccaaaaaatcagccatgcatagggaacatcaagtgaccgcgaccttggcttttcagtgcacaccagcatggtagggggctgagagaggtgttgagagaggtgttgggaagatggtggctaccgtgttaggtggcattaacagaggaagcccccacctctttgagcctctttgagctcagtttctctgtcaaatgagtgtatcccaaagcccgcccagccccagcttgggaaggtttggcggtggggcgttaggtggtagcctctgcagccagagagcaagaccacagcgaagccagcagggtgggactgcagggaggctgagggacagccccgaactgcactccttgcgtggggttagacacctaaggggcataatatgcagccagcaggtgtctgtagagcatctgcttgggaggagcacgcatctggactgggaaagaatggatctcagggtatgaaaaaccatggcctctgccaaggagcttacaggatacagctttgaagaggaagaaaggagtgtctgccatgcggaactgatggtactatatatacaaaagtgggagaagacaaagaaagaggatggttagagggggatggggctggcaagtaaggagggcttcctggaggaggcaaacaaacatcacagcatactagagctgtctgggacctcggggtgatcaaatgttaaaaaaggacatggctataaaaggttccagggtatccatgagggcttttggactgggagaaggttacagcatgggggtcggaccgagttagacatggcagaggacaagggagagactagcctggctgaggggagggtcccctttctccagccctggctggctctggatttaggacagtcctagtggttctattcccaagggagccgctcacaactacatccatcccagggggtgtcctggactactctgggggtggatccttgatcaggcagggaggttcctgctgtccctacagctgggcgaagggtgtgggccatccgtggggcctgcaggagaacaagtggaatctgcagcatgggacatctctgcctagagcctgtgcaaacaatggcactgtcctcatcattgagggggtcacgcacaaggcattccccagaggcctggcccttccagggcccaagcccagcctgagcctgcctgtgcgtgggaagagggtgatcggagcccagggtgcattcaagaacctgtcaaggtagttagttggtcaatgcgtcatggttaaataacttggctgcagtcacccagccagagtcacccagtaccctggttgggtaggaacttgccaccaggagtgcggtttcagccatgatttgcctttccctgaacttcccacccactgcctccacatccccacaccaagctcccccaactccttctcttcacataccaggccctctcctttgaacttccctctatctagccaagtatgttctcaagcactggtattgtatcagactctcacactttagtatgaagaggtaggccacttctgtaagcctgattcctgactttttgctgaagagactgagtttcagaccagggaaagtagcctttaaacagagggtctttctctcccttcctgagggtccacccttgggccacccagggggtcagaggagtcctgaccaggtttccttccctcaaaacctagctgtcttgcatttccaccaccttagatgcttgctgtggtgatggctgatttggcttccctgatgtgctgggtctgcaagcagaaactgccaggcttggtggaagcaatcaagagacctgggccacagacccagccctgctaccaagccagtgggtcgccttggacgaccaatcttgcatgaatttgtggccaccggagacctgcacacttggcatgcccttgccctcctgcttccccgcacagcctccaggacaccttccaggagccagcagagcagaacttctgggccgggtgaccttaaagggtttctccagctctaacgtataatggtttgaatggtgtacatttggactcagcctaggaactggggtagatgtttacagtcacagactcatagaggtgatggatccttctttgcaggaatgactttggggaccctccgcagccactgtgacacctgatgcatacgtgccagggacaaaggcttcctctccttggcttcagcccgagcctgagtggagagggagagagacaggaggaagaagaaaaagcatttccttcacagatgttgaactagccacactctaaatgccggggattgttgagatgcaaagcatgcttgctgtgcgagctgctcactacccacttagcccctgagcacgtctccctgatgccatcccctgcaggcagcctggtctgcggctgtgagacaggaagtggggctgtgcttggagagacaaagcctacagctggacccggctctttcctctctgagtcagggatgggtgggggacgaggctgtggggtgggctccagcggggaagtgtggccagattcagtcctcagggtgggttcatggggatggagggtgagagctgggtagggaaggaaggctggatccaggagtaggggttggggagccagacaggaggaacgagtggttttgaggtctgtgggtggactgggcaaaaagctgatgcttagaaaagtcctttttggtgtgtgtgacagggtctcactctgtcacccaggctggagtgcggtggcgtgatcatggcccactgcagccttgacctcctgggctcaagcgatcctcctagcctgtagctggaaccacaggcacgtgccaccatgcccagctaattttttaatttttaattttgtagagacaacgtctcacttacgttgcccaggctggttttgaactcctaggctcaagtgattcacctgccttgacttcccaaagtgctggtactacaggtgcgcgccacaatgcctgaccaaaaaaatcctttatagttgtacttttgtttattgatactcagttaatagaggtataaatgaatgagcgagtaagtgaaaagagggggtggagagagttgggcataaaggtaggaaggttggaaatagtagcttccgaatttgcctggctgcaggacgtcatggaggaggtgcaaggtggcattgggtgctgtagaagagaaaggcacctggaaggtagaggggagggtgtgctcacagtaggggaaatctggggcctcccagtgtaacagcaggaggggagagaagcctggagttggtgttgagcagccaccctcaaaaaagggctgcccagagccatggtgccctctcttactgggccaggcactgcccctcactgaactccccgctactgggaagaggttgggagcggagagcacaggaggggctaggggtgtgtgagagtgtgtgtgtgagtgtgtatgtgcgtgagaatgtgtgtatgtgtgagagtgtgcatgagtgtatgtgcgagtataggtgtgtatgaatgtggatgtgtgtgtgagggagtgtgagtgtgtgtgtgtatttgtgtgtgtagggggatcagtgagggccaggagaggtagactgagacgtttgagatgaaagcacaaagggcgcactcaccatgcaaatggccttgcagcggaagcctgttatcaggagcatctgatggggtttttcagggtggaagccagcaccccgggcagcacaaggctttcccggttcccaggcagctgcctgtagttggcatggccctggcgtaatgcactactcctggaccctccagctaagagtccagacacactggcattacctggtgccctagaaaccacctgccttgtcctgtgccacccacccaccacatcctggggatagcctctgctgaaagcatcagaccctctcaagcagaaactaggatgggagtaggtggaagaacagggcttggggtcctcttaggtgatgagaaaagctctccaccaacctggtcttccccaaacagcctggagtgctccctgagagcttcctcttgcctcctcctcacccccaggcctcctacaggcaggatgggactggtcaagatcaagttctcacctgcatggtaccaggagttctgatctgggtccctaagcagctactggtgtttcctcaaggaggcaggccagtgcaaagctttctcttccttccccttcttggggccttgagagagtctggaggactcctgagtccaaccaacttccttccagactgtgagcttcttgagggcaggaccgtgtcccagcacagtacctggcacatggtagatgctcactaatgacaaatacttatctggagcttactgtgtgctcactgctctcagagcatagagaggtaaagcaccttgcctaaggtagcacaactaggaagaggtggaggtgggatttgaacccaggcagtctggctccagccatcccctctcatgagttaaggtgtatttgtttgatggaatgagctcagttggtgaggggacaaccctgaggtcacctctgagtgagtcagacctaggaccagactacctaggccagaacagccttggggcatgagatccttgggccccactctccaggcagggggtgggtgattactgaagggtgaggtccctggggtcctgctgacggtggacagagcagtctcctgggaggcttttgccaaaacctgggagagccatcttctgcttccttcaaggtcaccccagcggggcagctttagccacaattgtgggtggggtgtgtgttggagagtgtgaaaggaggtggggaaggaggttccaggaggatcagaagagatctgagggtgagagtgtgtgagatgaagccctgaggggcacccttgacttctcccactctagagaaagacaggctggtctgtcaagtggttgggggtgtcctggggtccaagccagaggtcatcgcatgtgtggaggtgggggctctggttttatgatgaacctgaccaccaaggaccatggggtgaaggtgcagagaacagaagggcacagactgggggcagcaaggggaggaggcggccgctgttcacctggggtcattgctttcttaatgggaaaagagaggctggaagttagcctggggagcctgagacagacaggaatagtggaggtagctgggccaaagcaggtgcagcctgatagagtggtggccccaggaggctcaggagcacctgagtcaggcagtagcccccagcccagaagagcaattagcaagttggcaaacaacccttcctctgccctttagttcagaaccctggttacttgtttaactgatctgatagcatctcattggccataaggcagcatcttcattaagacccccatatttggctgggcgtggtggctcatgcctgtaatcccagcactttgggaggccaaggtgggcggatcacatgaggtcaggagttcaagaccagcctagccaacatggcgaaaccccatctctactaaaaatacacaaaaaaaatagctgggcgtggtggcacgtgcccataatcccagctactcgggaggctgaggtaggagaattgcttgaacccgggaggcagaggttgcagtgagccgaaatctcagcactgcactccagcctgggtgatggagtgagactcgattaaaaaacaaaacaaaacaaaacaaaacaaaaacaccaaaataaacacatttttctgggttcataagactaaggaagcccacttgaatttctccagttgtccatcttacccccttggcactcagctaactgtgggtaattgagatttcacagagggacccagtgagtggtgtctgcagggctgggatgccaaacagtatgacttcttccaggggatgacgttgttcctgctgacctctgagcaggctgaagcctgccacacccagaattattctggggtctaggaagataccttcccagcagaagccatgggctgagcatgtgtcggataattcactgttgaggaaaatagatggtcattttctaaatatgatgtcatggtactatttcttcaaaggaaatacgatcccaaactgcaacacagaaaataaacagagggaaactgggtctttgaggcctcccaggctgtcttcatgggccctgtggggttcccgaggcagtgccagggagccttctttgagagcagccctgggcagaccagggcccggtgtggcctgaggcctctgtgcggttggctacctttcctggtcattaatcgctactaagtgtcattaccactaataaaattaaccgacttgatactggactctctgagccatcaatctcagggtccattagatgaaatttaaaaaacagatgcctctggggtggggcctgaggatttgcattccacagagctccaaggcaacactggccatgcagagctgggcaccgtttgagacccattgctccctccagggtctcttcccctgggcatcgcggacattgtggttggagtggagccgttctgggcactgcagagtgctgggcagcgtccctggtctccacccactccatgccagaagcaccaaaaacgaaaacaaaaatgaacaaaccaacaaaaaccagatgcctgttgaatgagtggaggggtttgctgggtctggctcccaagtgcagcctagggaattctggcactcttcacatgtcagaggtcataatcaaggatgatgcatttagttagacaaaccaactttgagccttcgctccacactacatgggagtcccagacaagaacacagcttgggcagggtgcagtggctcacgtctgtaattccagcactctgggaggctgaggcgggcaggtcacttgaagtcaggagttcgaaaccagcctggctaacatggtgaaaccccgtctctactaaaaatatgaaaattagccagggatggtggcgcacacctgtagtcccagctactcgggaggctgaggcaggagaattgcttgaacccgggaagtggaggttacagtgagctgagatcacaccactgcactctagcctggaccacatagcaagactgtctcaaaaaaaaaaatgttatatatcatgtcatatcatatgacatatactgtagctataatgatataataatcatagctattattcttaaaatggcatttgaggcaggtcttgaaggatatgcagcttcattggccaaaatttccatcactccctgcttgctctcccctctgtcaatcagttgctatcagggaggtccagtttctgaaacacaggaattgtgtgagcagaagtcgccactcacaccagccctcggtgtgagaaggaggacatttgagggcaaggtagctgcagcccccaagctgccctccacactggaagccagtcaaggcgtggcctcctcagctggagttgacatccagttcttctctggacctgccaagggtcaaactctgaggatttcctgccaggctgcagggaggggtttgggtgtagacctggtggactggaaaattacccatttgcccccagattaatgattaacgggtccctgccctcaccctgtctgggagaggagcccagggccaggctaggccaacgggagcccgatagcatctgtctctgctcggaggtttcggagatatgctccatgatgggttgactgcacctgatgggtgtggaatctacaggtgatttctgagggcacctggggcctggccaggccgcataccctctggtgaggcttccaacttctggggcatacagagagggcatggcctccagccagatgtcctggctaaggcaggtgactccaaagaggagagctgtgcccttggctcagaggaacatgggcttctctgaccactcctggcttgaccacaggacttaccttggccagtggcacatgagcaacagtggcaagtgccacatccaagcaggagctctaagagacattgcctgcttccacctttgctttttttttttttttttttttttgagatagggtcttgctctgtttcccaggctggagtgcagtgatgcgatctcagctcactgcagcctccacctcccgagctcaagctatccttccacctcagcctcccaagtagctgggactacaggtgtgtgccaccatgcccacataatttttctatttttagtagagacagggttttgctgtcacacaggctgctctcaaactcctggactcaagcgatccacctgctcagcctcccaaagtgtggaattacaggtgtgagccactgtgcccagcccacctttgatcttttaccctggctatgaggccaggatatcccagaacagggttacttctcttgggctgggtcctggaatgatgtatattccacccacactgggggcaccaggatataggacagcaaacattttgaaccagcagagccatctcacagagagcttctgggaagagggaagacgaactctaattccaattcccaccctgctgctgatctgttgtatgaccagtccagtcactgccccctcgtaaatcctttgtttcctcatctggacaaaggggagactctgcttagctggagagtaaagcatcttgcaaaatgagggaagtttgggaagctccagctagcaggaaggtaggcctgcttgtcccaggcactgtggttagtccatttcatataatcctcccaccaaccctaggaggtagagaagatcactctgcccagtttccagaagggaaaaaaccaaggtgtcaagattgcatagctagaacatcagccttagaatttggtagcttggctccagaatcgatgaactttcaatctaggagaacaagaagtctgggattgatggcctgatgggaattcagctccttcaccttcatctaaccatccatcagtccttccttccttcccttctctttccttccatccccttctctccccaggcatctgtttgtaccaggcaccaggtggtcagatggttgaaggtctatctgggaattatggaaacatgttagattggtacaggattacttgggcagcagcataatgtaagggagagagggatgtcaggggaccttggctgggtgtccgctcaatgtccacatcccctctgcctgccccctctcaggaatgtggctctcttggccaggcagccaccaatactctgtgcattatttcccaaacttcccggatcacaaaagctgcctagggactgtggtaaatgtacagattcccaggcccaattccaaaccaatagacccagaattgcccagcatggatcctgggaaagcgtatttttaataagcaccccagatgatttttctaactgggccaatagggaaataggaaaatagggtggataagaagagcagagaccggaatctggaaaacaggtttaaggtcctgcagcaacctttgttacatgaaccttggtttcctaatctgtaaaatggggacgggacctccagcgggtcagcctgctgcccagaagggcagtaaatgaagcccctgaggaggccccttcccttcatttgcccctcaccaccatccccaaggctcacctgtctccctcctctcgctctctctagcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggacgggcctgctcaagagaggtggggaggagggctaggggacggggagggctgggggaagaagccttcagggaggaggaggctgggagaggctgccctttcctttttcctggctcccgtgcccaggccacactgcccttcctgccctagcacggtcccaaatgagaagagtcacaagagttaatgaggggcagttgaaggccagctgtggcccagcctcaggtttgggggagcagaggagcaaggaagatccaagagaggaggagacacaagcctattcctggaggagctcacagataagatggggtcccccagttgtctccctctgcctcttcacacacacacacacacacacacacacacacacacacacacacgaaacaaggcacatgaagacgtgaggatgggcggcagctgattccaggcccgatgacacgagccaggcgatgcatttgttcactcctttatctgtccctttgtttgtcacatccatcgatccatcagtccctccttcccttccactcccattctacctccctccccactccacccacccactaagcatccatggaggcccatagtgagccaggcactgtgccagatcctggaggttcagagctgaaccagacccagctaccctcgggaagcatgcagtctggaagggagaacacaggtcaccatgtgactcccttgccaaggggaaagggcttttgacagggaaggatgagggaatgtggcttgaggacacagctccgggtgggtctccctgtcaattgccccttaaactctgactcaagttgccatttaaatggaacttctagcctgggcgcagtggcttgtgcctctaatcctagcactttgggaggccgaagcgggtggatcactttaggtcaggagttcaagaccagtctggccaatatgatgaaaccccgtctctactaaaaatacaaaaatttaaacactgcagttggccggttgccatggctcacacctgtaatcccagcactttgagaggccgaggtcaggagtttgtaaccagcgtggtcaaaatggtgaaaccccatctctactaaaaatacaaaaattagctggcatggtggcaggagcctgtaatcccagctacttgggaggctgaggcaggagaattgcttgaacccgggaggtggaggttgcagtgagccaagattgtgtcactgcactccagcctgggagacagaatgagactctgtctcaaaaaaaaaaaaaaaaaaatgcagtgatgctgtacagggcagccaggcccctcctaggccagctgctctccacggtctgcagccaagctaatggcctctctctgtgtctctctcgggacatcaccagcacccagatgcactggagggcaggcaggaagtagtgagctggtgggaggccaggtttgggccacacccagcagagaggagtgtcggtggttctggagtgggtgggatggtcagtctgaggcaagtcagccaggagactcaaggtcactgtatcattgggtctattccacagtgggtagcagagaatgacatttgagaaccatcatgtgtcataggaagcccatggggcttatctcaggggcctcagaaatgggcccatccaaatggtcatacaccgacctggagtcaaaatggcaggtttagccccaactgtgcctacgccaggtgtctgagtagcttctctttgcatctcagtgttcttctctgagaggtgaaggccgtagcccctggcctgctgccctctgggaatctgggaacatactccatagtgaatttgtaaattccatttatttatttatttataaattaaaaaaatttttttgagacaaggtctccctctgtcacccaggctggagtgcaatggcgcaatctcagctcactgcaacctccaccttccgggttcaagtgattctcctgcctcagcctcctgagtagctgggaatattggcatgtaccaccatgcccggctaatttttgtatttttagtagagacggggtttcaccatattggccagactggtcttgaactcctgacctcaaatgatccgcccgccttggcctcctaaagtgctgggattaggggcacgagccactgtgcccagcctggaagttccatttaaatggcaacttgcagtcagaatttaaggggcagttgacagggagacccacccggagctgtgtcctcaagccacattctcttgtcctgcccatcacagcgctgccaccaccgcctctggccctcagagggcggcaggcaacctctaagcttcctcctttcctctcttccccctttcctccctccctatgcccctgggtgcccgatccaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggtgagcatgtccctggctgcccgcagtgccttcccaccagggtacacagctggggagcatggcttgaaggaggccagcaccccactccccaaaatacatgaagagccgtgaacttcataaaggcaggatgaacttcacgtcttcaaccagcattcccttggcatctactctgggctgtgactgggtgccaggaacacagcggaagcatggaagggtcatgagtgtcattggtggaagcagtggtcaccagtgggagccaggcttaggactaggtctggtgaagcagggacatgtttggagaggggtctccattccaaggaccaggccttcctggaggtcctggaagcccaacattgtttgaaaacctccatctagagcaactgcccacttctccattttatgggtgggaagatggaagtggcccagagaagggaaggggctgaggttacacagtagtgggaggtctggagggtgaaaagtatcttggtctattgaggggaggaggctgggagacaccagtgctctagctgtttatgagattaagttctgagttgtcatcactgagttgtgaaccggggctgctgtgttcaatcattgagttggtgtgaaccggggctgctgtgttcagtcactgagttggtgtgaaccggggctgctgtgttcagtcactcagttggtgtgaactgggactgctgtgttcagtcgcgtaagttgtctattccacaagaactccaggccaaggggaggagctggggctgagaccctgggtctctttcccattctcctgcctctgccctgctggggttggtgctctgggggcaggctctggctgctgggcccaggcctctgaccacgcctctgttctgcctcccccacaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgggatgaatggcttggagccagcatgttcttgggaggtgaactgctgggctaggaatgccaaggcaggcagtgccagctggaagtgaaggcgggagcctggctgagatgggtcaatcgggtcctgtggccctgctcaggtgcagtgggctccaggtgtcacacacctccaccactcccctggttttgctgtgccagagatggggagaaagcacaggtggtagaagccatccgttcagagaaaggagagctttctgtgcttgagtggacccgagtgagatctgtgccctggagccctgtgtccttgatttggcttttcaaatatgcctccgctgaggcctcattcttgtctcgagagctgggttatgcacactcacccagccgtgctcaaaactaccaccagtgcaggtaagacaggtgggagaactagccaccaaggcgggactcagtgcacctgaggttgaacagggagacaacggcccctccctgtgttccctgctggccaaaggaatcttcactcccagcgcagaggaggagggcaacagcttcctggtgcctggcagtgacgtggcgagctcagtttctcagctggctcttgagtgagctttggtgacttcctgtggctggggcctgcctggtctgtgacacccccataccagctgagttcacaatactgaagaacagctggctcacgagctatgacttgaagttacatttctattcttgtggctgctcatctagttaaggcttttgccctggctggggttataggtgcttgagtccttgctaagcctggctcctgggtagcctccttcagttcctaatggcctctcacttggccctcactttggctcttacttgaggaggagacgtgactttgataatttcctcagatcctgtggacattttcagcagcacctgccaaggccctctgtgaaaggaggagagactggtacctccacacaggcacacatggatgcacagcccctggaccaggctgggggttcctgttgcacatgcctctcttgttcaggatgaagaccttgcaggggtccccttgctggaggcattgtacttccccagagtggggcccgatgccacccaggaggaagtgacttctttcgggaagcccttggccactttgctggccctgccacgcccatctgtcagcttcctttctccctaaacctagagttgctgacccttcaccaacacaggaaatttcagaatcagctgaatgctcagaaacctcgcctgtgccagctccaggacaaaggcccgctgactgtgccctggccaactccctgagacctccaagggcgaggaggagctgcccagtctccagtggatcagggcagtctgctggatgctggaaggatttttgactgcagaggcccggctgagaagccaaactgacctgagcccctctcgttaaaatgacattgctgacccaagcacctggcccacaccttggcagcaggagaaaaatggggagagggctggttttctcctttcttccacttccccacagcatggagattttctctgccttcccaatccatcttgctcctccgagaccccaactctgcctccacccaggctcagtgctgggcgtaaggcagcagggacctcactggcagagcagggggcctgggagcaacgtggaggccagagcaccctgatccaccaacatgccacctgcattctgacttcatggctggcagtgccagggtcgtgggagggcaaagggcaggctctaaggcatctaggcagtggctggctgctaacatggacaccccaagtcaatggcacagtgcaggttctgagggctccttggcttgtggggtcttctctgtctgtctctctccctctcttcttccttgctctcatccctttcttttccagttacccctgaagacccacctcggccctcttggggcccctggggactagagtgaccactgacccctcattctacagctttaagggaaatgctcacagggtatttttgtctacctcaaatatatagtttttagagcaaaggagaataatttatatagctaagatatatgagaaagtatttatattatttatatagttgctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaacttttacccctttcatctcacttgatttctccgttatctctgtgaggtaggtggggccacattactgtggccattttatagatgaggtccagagatggagagctgtgctcaaagtcacacctaagagacttgttcaatgaatatttactgaacatctccatagaccaggcactacgggctgacctgctctgagcccaggagccccaaagcctggataccactgtgagcccaagaactcagggaagcagttccttcccaggctgtgatcccagccttttggatctggatggcatgttggcacttcccccaagtggagtcccatgtctcaggggctttggctgcctgagaaggctggagagaccaggaacccatggaggccactccaaggggtccttctgcccacactgcccaagaagcttgggctacaccactgggcccctcccaacctacagatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgcatttactttgtctcaatttattgcaataactttgcacattggacatggtccccgtaatggataaggaaatggaggttgtgagatgagaagcctcctcattgcaactggcaggcagtggggccaggattggaacacagatctcctggcctccaaagtatgggatttttttcctctgtacactggtataggtcgggcagggatggatcgccccattttattgattctgggtaaactaaggcctagaggaaggaaataatccatcctggattacacaccaattcagacaggccagagcctgcatccttcctggagttgataagcatttctggagccctcatgctatggcaagcagcatggctcagggtggggcgggatgaagccaaccaggggccttcagggacctacagtctaataggagaaatgagaagcacagccatgcagtggtttgggtcatttacacacgaatcctgtgtcccttttctggccacagttccttcccaacatgctttgggaggcctcgcccaccaggatcctcctgggggtctgatgggagaggaggcctctttctgagccaagcacagcagagagtgcctgtctcctggctcaggcctgccctgccccagttcttcagccctgctggggtccacattgccttaactgggctccccagggcgggaggcagaggtgggcccacagtccagccctgcaggggcctacatttccaccagcatccccgtcctaacatgctccttctacccagtgttcctgggcctggagaccagctggctctgagtaatgacagacacgtccacatgcagcagcaggctccagtttatcaagggatttctcatctattttctctcttgaacctcacaaggtggacacccttcttctttttttacagataggggaattgagacacaaaatggttaagtgacttaccaaaggctatatcgctagcaagcggatccaggccttttgcctccaaaccccatattctctctaccatacaccatcctcacctcctcctgccctcatctgagccttactttgttcctgctcataatctagttcccaaacaggcccgcagacccctccacctccagctgctcaatgccaccatcttccaggaggaccggggcttgttgagacagtcactaggtgggtaccctacccgcaatatccctcctcctttaaaaacagccacatgtgctttctgtctttgcatttgcaatatctatcttgttgaatcacttgtgagacctttgcagacaccaagacacttacatactttatcatgtatctcctaaggacaagaacattctccaacagaaccacaaggccatcaccacatctaagagatgtaacattgacaaaaattatctactacatagtccatattcagacttccccaattgtccctcaaaatgtcctttataacattattttctggccaggcacaggttcacacccataatcccagcgattggagaggccgaggcaggaagatcgcttgagcccaggagttcgaggatatagtgagctgtgattgcaccactgccttccagcctgagcgacagagtgagaccctgtctctaaaaaattaaaattaaaaaatttttaaaacatgttttcctggcccaggatccactcaagaattaggcattgcacgttgttttcatgtctctccagctccctgtaatctagaacagtccccctctttctttgctttcataacagtgatagtttgaagagtccaggctgcatgtctcgtggaatacctctcaactgagatttgcctgatcgtttccttgtacttggattcaggttaaacattttggcaataagctgcttgggtgatgtgtatcctattctgtgcatgctgtaaggagccacaggatgttttgctcttgttgcccaggctggagtgcagtggtgcgatctcggctcacagcaacctccacctcctaggttcaagcgattctcctgcctcagcctctagagtagctgggattacaggctcacccatgatggggatggggacattctggagggagaggcactggcgggaagcatcctatgcctgcccccacccttcccatttctttccgattcttgacttcgctccatctctcacctggagttccttcttgcaaccgatcatgcagcaaacacggattggtggcctatggtgcacgaggcacgtgacagggtcctagatgccatggtaatgagactaggtccagccttcagggaggtcccagacaaggggagagacaagcaaagagatggctggcatgcacggtgtccagcactccaataggtggctctgtgcaggctccaccccacacaggcattcctgtgcaggccatttcctcatactcccctctgggcaaccccaggggtccatacaaccatgatccccatttttttttttgagacagagtctccctctgtctcccaggctggagtgcagtggcatgatctctgctcactgcaagctccgcctcccaggttcatgccattctcctgcctcagcctcccgagtagctgggactccaggtgcccgccaccacgcccggctaattttgtttttgtatttttagtagagacggggtttcaccacgttagccaggatggtcttgatctcctgacctcgtgatccgcccacctcagcctcccaaagtgctgggattacaggcgtgagctactgcgcccggcctttttttttttttcctttgtgagatggagtctcgcttttgtcacccaggctggagtgcaatggcgcaatcttggctcactacaacctccgcctcccgggttcaagtgagtctcctgcctcagcctatagagtagctgggattacaggcgcctaccccacgcccggccttatttttgtatttttagtagagacggggtttcaccatgttggccaggctggtcttgaactcctgacctcaggtgatccacccatcttggccttccaaagtgctgggattacaggcgtgagccactgtgcctggcctatgatccccattttatagatgaggaaactaaagctcagagaggttcccttgctacacaataagtagcagggctggaaatgaaacagcttcttcactgcctcttcccggggagtgctgggcacggcctggggacagagagacggggtatgagggagttgcaaggattcagggcgactggtggcatcttccagtcctgccacttggtcctccttgtcttctcctctctctctttctccccaccctgcataccgcaaagaggaggttaatgcctctcacgcgtcttatccccccactcccatccctcctcaagtccccaggggctgtggggcccatattcctccctggctctcttgggcccattagtgtgtttacgctggagccgtctcaggggagctgagcccctacccctgccccaccgtcctcccgccatggagagtgggcagtggagtggtggaggccgggcagaggcacgggagaacctgacccagcgtccgaattcctgcccccacgtctcaacaagtccagggtggccagaagcctggagagcaacggtagccccccgggacccccacctcttcccacacagccccaccagagcctgacaggctctaatctcagctgtcttcatgcagccagccctccgagcccggggtcacctgacgctgacacattttaattcagaagctgatttctgcttgttggcaacatgtcatttctgaaattgctttctctgcccagaggcgggagatgtcagagctgcgcaggtgttgcagtggtgccgcccccgccccacacccagccccctctccaagttcaggaaggattaaggggcgtgagggggcacacaggagatcctcaagctctgcttctcatgtttccccaagtgctgggggccagggatgggggactcctggaatggcctctgctttcctttccagcctgatgacagaggcccagggtttggtaaatgaagttgctgctctgccagtgctgacaacagccacagtagttgttttgcgcaggcttcatacaggtaccaagtgctctgcagagtgcctctcgtgtgcattgttgtatttgaatcttatgacaacgctccaagttggtgtcatccctcctttgcagctgagaaaaccggggctcagaggggttagaccacttgcctgaggtcacacagcaagtatgaggcggggccagctttcagacccagtgaaggcgacagctggactgggattgggaggtctgggaagggagaggccgtggagctggggaggactatggcctggcttctcctatatttgcttcctgacttggttcaaatatctccagtgaaatttgtgaactcccccaacttccccactcctgcaacccatcaaatagttatttgctccctcttttatatttccttagcttttttttttagacgaagtcttgttcttgttgcgcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatctttaaacaaaatttattgtcattttgtcttttgacattttacagatgggcaaagtgaggccaggtgagcaacagcatctgttttttttgtttgtttgtttgttttttgagactgagtctcactctgtcacccaggctggagtgcagtggtgcgatatcagctcactgcaaactccacctcctaggttcaagcaattctcctgcctcagcctcccgagtagctgggattacaggcgtgcaccactatacctggctaatttttgtgtttttagtagagacggggtttcaccatgttgcccaagctggtctcgaactcctgggctcaagcaatccacctgccttggc

SEQ ID NO: 39 - DNA, 1464 bp, Homo sapiens
gcgaggagatgctagagggcgcagcgccgccagcaccatgcgccccccgcccgcgctggccctggccgggctctgcctgctggcgctgcccgccgccgccgcctcctacttcggcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggacgggcctgctcaagagaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgg

SEQ ID NO: 40 - protein, 355 aa, Homo sapiens
MRPPPALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRTGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 41 - DNA, 80423 bp, Mus musculus
  misc_feature (1)...(80423): n = A,T,C or G
ggtcactgcagttggtactagtggctgagggacaagcataataatttttcccttgaaacctctgtgaaaaacatttagctgttgagggggcttcacgctcaggagagctcctcctcatgatttcgggtgctctacacagtcagagaaacttctctagtaacgaactatagaaatgatccctgaaagtatagtcttggagctttacattcttctttaaaaggttcaccttaggctgtgcggtggtggcgcacgcctttgatcccagcacttgggaggcagaggcaggcagatttctgagtttgaggccagcctggtctacagagtgagttctaggatagccagggctacacagagaaaccctgtcttgaaaaaaaaaaagttcactttagctaggagtagccgtgatgacgtcacagttggccataagagacacggtcggtctttaaaaccggaggggccttagggtatgtttggactacctcagataataaggcgccctgtccaatagtccaaaagtctccaaataaaggtgctagcaggaattagggggctctcagacaccccaggaattagataaaagtaagccagaaaagttattttggcctgtaagcccttaatcttatctttagcaggtcttttatggagttaacaaggccaggtggttttactgtaactgaagcttcgctgtaaaatgtgcgctgcagaggaagttactctgagagcagtcaggcaaaccaggggcttcaggctctgagttcggatcctcagaacttagataaaagctggtgtggggtctttttaaggtcagatctgttgctctgtattgtaatgctaaattctgtacccagaggtctagacccacaagtgaattctctcaaggttacaagcttttgttgtgcaaaccttattccttgatttaaaactactggttaaataaaattgattgcagccaattactggagggattagaggtaggtgggttttttgagtgacctggttgtggggtggaggagcaaggggaagaggagaaaccttgaggtgggagaggagaaggcaccttgagaggagaggtacggtgagcggtgagcacgtggccgggagaaacagcaggtatttggggagcgccgctagggaggtagccagaccagcagatagaaaagtagacccttcagtaactgtcaaggccaaataaaagaaccatagcctgagtctcatttgtaagctagtcagggataaacataaattggttgtaccgcagtgtcacctgtttgtaaccccgggagcttgtgaagcagagacaggcaaatcccagggggttcactagccagacaaggtagccaaaatggcaagcttagggttcagtgagagatcctgtctcagaacataagggtggagaaagtcatcccgaagtcaagctctggtctccacaagtgcctgtgccgatgagtcttcctgtgtgcaaacactacatgcagtgcacagacacacacactaggcagtatactctcctgaggaaccctattctggagaagtgtgtggaaaacgaagccatgccacagctgaactatgtttcagaagcattctgacgaaggaaggagctggcgatgttgctcagttaatcctatcatgaaagatgctccacgcatgcgcgaaacccctagcatgcacagcgtcctgcgttccatccaaaacatcctgcaaactggcgtggcggttcacccgtgcaatctcagctcttgtggagtcaggaggaacagacctttaaaatcatcgtcctctccatagtgagtttgaggccagcctggtttacgaaaggcactgtctttagatacctaggggaacaaaagaattgtgtttgtttaagtttagcctgggacaagtctctggtagagtgtcactgaggtctctttatgcttctgttgagtagtttattaatgagggttctgatggttcagagattagatttgaggatgacttaaagccagaagggagaaaacagagatagaatcaattgtcaaagaaattcattaggagccaggcaccaccacactggaagtgcaggcgggaggaccagaagatgctctgtagtagtcaggactaaggagaacctgtggagataaatacagcagcaactgactaaacaggcaaagagctgccaaggcaatgtccttaagcagatgccattgtcttatctagtacagaggtgaaggtggagagaaagagacagagagaacacgtgagtgagagaaggaacctccctannnnnnnnnnnnnnnnnnnnggatctcagtctgtaagctatgactcagcatggaaagatctaccgatgaaccgacctcccacaaagctctggaggacagggcagtctctttcccggggcccagcccagagccactccatgtcccatggcttcctccctacacctctggctccaggcctgtcctggagaaacaccctggcccctcgaagtctccagcctcacccagtgctgtctgacttgagagagaaatgctattgggaaacagatgacttcagccctgggaaggtctggtatttctgtgtaaaggtattccggagtcaggcttcacccccaagaggtcctgaggacggctgatgtcaacccaggaagttcagttattgttgactttcaaattagttggcttttataagacaggagctaggagccatctgtaatcacccgctggcccttaattgcccatctataatgtgaattgtggtgctctctgtgggaggctgagttgtcctaaaaatgtgaagcccctatccccatcctatgggatgctaccctatgtgtatcgtgtgtcagggttagtcccttgggctaccatatggaataccatagagttattgaaaagagaaatgctggtgtgagggcccagagattggttaagaatatttgttgcggggctggagagatggctcagctcttttttttttttttttttttttctcgagacagggtttctctgtgtagccctggctgtcctggaactcactctgtagaccaggctggccttgaactcagaaatctgccagcctctgcctcccaagtgctgggactaaaggcttgcgccaccatgcccagctgatggctcagctcttaagagcaccaactgctcttcctgaggtcctgagttcaattcttagcaactacatggtggctcatggccatctgtattgggatctgatgcccttttctgaagatagtgacagtgtactcatatacataaaataaataaataaatcttaaaaaaaatattttctgcttttgctggggacccagcccccacagggtagctcacaactccctggagttctaatctggggaatccaatgccttcttctggcttctttcaggcacaaggcacatatgtgatatgcattctacacaaatgcaaaacacatatatgtagtataaaaatatataaatcttttaaaaagaaaagaagaaatgttgaatgtgctggtgcacttttggaggtaggggtagaaaaatcaggagttcaaagatattttagttacatgacaagttcaaggccaacttgagatagattgaaacaccctcccccccccccccccccccgtcttaaaaacaaacaaaccaacactcgggggcagatgaattggtgcaaaacattaaaataaataaataaataaataaatattaaaaaataaaacaaaaaaccccacttctacctcttcccttatttttaaaattaatttacttttattttatgtttattggtgtttagcctggatgtgtgtctgtgtgagggtattggagaattacagaccaggtggtggtggtgcatgcctttagtcccagcacttgggaggcagaggcaggaggatttctgagttcaaggccaatctggtctacagagtgagttctaggacagccagggctacacagagaaacactgtctcaacaaaacaaaacaaaaaaagaacttgagttacatacagttgtgagctgccatgtgggtgctggaaattgagcccaagtcctctggaaaaagcagccagtgcttttaaacactgagccatctctctttttcctttggccccctcctcttctccccacaccccatcattgcctggctgccttcacttgtttaaaccctaatttacagtggttgtttttttttttattgttgaggcagtgcctccctctgtagctcaggctaagttagacggaacttatgcagccaaggatggccttgagcacatgaaggccctcctgagtcccagtgctgggttttaaggtgtgcaccaccactgcctggctttttttttttttttaagacttacttagctttaaaaaaaaaaatgtgtctgagtgtttgcctgggtatatgtatacacagcgtgtgctcatggaagtcagaagagagcacgggatcccctggaactgaagtgacagacagttgtgagcctccatgtgggtgctgggaactaaacctggatcctctgcaggaacaagcacactaactgcagaagcatctctccagcccccgtctttttaagtaaggcgtccccaagacttattaagagaaggtgagataaatgctcaaaagtgagaagagtcccaggcagccataccccaggctcctatatttattcttgtgaaaataagaagaaaaatcgtgtgtgttaaaacatatgtgtgcacgtgtgcgcgcacagcacacacacacacacattgtaaaagagccatccgaagaggaggccagaagccatttggaagcaggatacccaccctctgaagatgaactttgttcccctgaaccctctgattgcagggataattacagtgcaatagattgcaatagataattacagtgtgtctgagccttccaagtgtgtctgagccttctgggtccagccgcagaggtaagcagatgcctgcctctaggcatctttaaccaggtcagataacctctcttcttcctctacgtcacaggacacctgttcttcctcagtctctacaatttctacagaggaaatctcaccgttttttttttttaaacttgtatcaattttttaaaacttgtatcaatttgtatcacccagtacctctgcccccttcccctgccttctttgggacattgcatgagagccgtaaggactcatgtctacctgatttcaactcttgaaatccttcacggtttccagtgtccagctgactgacagtgccctctgagggttaagtggcttacgaatgctagttctcatgggagcttcctgacacatgcaagcagtgggtagatggtcatcttaactccattctaggtaaggagtgaggtcatccttaaaccgcagaggagagactagaactctctgtcctgcacactcttgcaggcataaaccctggccgggttgtgtccgatgcctgtggataggggattagtcctccacagccacttcccaaggttcagtagagctttggacacaggctgggggctcatggctctgaatcatgtttattgtcaccatagcctagaagtggatggaggtctgcctggcctggtgcccgcaccaggggtctgtcacctgccctgtcctctttcccccagcccacccactgcagctcctcagaaaggctgccatcagacatttaagccagtaggcagctttctaggtgtgacatgggcctgtgcccttgtaggcaggagcacaacacacagagatgaccatgtgtacttcttcaggtgaatgagggaggagagggaagagggagaggaagaagaggagggggaggaagagaaggaggaggaggggaggaagagaatgggacctgatgggatctagtcccagtgctagtgacatcattcattcttggtagtgtagggtcagacccttgatgcgtcaacacagttgtaggcagcctcccctgcctgtctttccaacaagggcttcagtaagaacaggggaagggaaggaaggtagaaaaagatcatacccaaacaagaagcaacttaattcattactaatttaaaatttgtagttgtttgtttcttgtggaaggggcgggcacatcactgtgcttgtgtggagatcaggggagagcaggtgggagttaggttctcctgttgtgtattcagactcactcaggttatcaggcttggtggcaagcacctctcctggctctctctctgtcccttagtttactatttttaaatgtttttacatttttttttttttttttttttttttttggtttttctagacagggtttctctgtatagccctggctgtcctggaactcactttgtagaccaggctggccttgaactcagaaatccgactgcttctgcctccccagtgctgggattaaagacgtgcgccaccgcgcctggctatgtttttttgttttttgtttgtttgttttttggtttttcgagacaggatttctctgtgtagccctggctgtcctggtactcactctgtagaccaggctggcctcaaactcagaaatccacctgcctctgcctcctgagtgctgggattaaaggcatgcgccaccaacacccggcccggctatgtttttactttttaatgggtatgagtatgttgcttgcaggtgtgtatgtgtatcccctgcatgtctggtgaccacagaggtcggagagggtgtcagctcctgattgtgcactactgtgtgggaactaggaatcaaactggggccctgtctgcaagagcagcaaaggttcttaccctctgagtcctcttcaacttattatcttttaacatgtagccacagctggtcatggtggtggtcatgatggaacaggatttaatctcagcactcctgacaacaaactgggcggtgtgggacacatcttcaatcccagcactgtaggcagaggtaggcagaggatctatgaatttgaggccagccaagtctacagagtgagttccaggacagctagagctactcagagaaaccctgtctaaaacaaaacaaaacaaaaacaaaaaactggggctggagaggtgactcagactcttgactgttcttccagaggtcctgagttcaattcccagtaaccacatggtggctcacaaccatctgaaatgggatctgatgccctcttctagatagagtgtctgaagagagcgacagtatactcatatacataaaataaataaatcttaaaaacaaacaaacaaaatgaaagaagaggaggaaacaaaaagagagaaggaagaaaagaaggaagggctctttaccagctcttcaaaccagtcagagcaaggatggttttctagctggaaaccatcactttgtggctcttacagtgaggcaagagactagtcctcaactgcaatgtgtctttgttgacccctgaaagccctgaaggatggcgcttcagaaacaaagtggcaggttgggcttgttgctacagctgggtcagggaagcaaggagctcaagctagccaaagccatctgaaatcctgttcctaaaacaaaaaaggaagggagggagggagggagggnnnnnnnnnnnnnnnnnnnnaaggaaggaaggaaggaaggaaggaaaggaaaggaaaggaaaggaaggaaggaagacagataagcaggtaggcagaaaccattaaggcagaaataatcaaattctgacaatacagtagttgccatcactagcctggaaaagcatcaaagtactgctccttgggtctattattattattattacttttgtattgttttgggacatagtctcacaatgtgaccctggcccaaactccagactgtccttgaacccaaagagattgatctatgtgcctctaccaccagaaccctggaattaaaggtgtgtgctgccatccctgactgttgtggttttgtttgttttaaggcagggtcttctgaaccttggtctgtaaacctaaacatgtagccatgaaagacctttaacctctgaccctcttgcatcaggcttccaaataggatttgcagacatgtgccaccatacctgacttatgtggtgatcaatggtgggccagcgctctaccagaactgcagccctggtctctggctaatgcttttctatttattattatgcttttttccccccaagacagagcttttccatgtagccctggctgtcctacaacttgctctgtaggccagactggccttgaactcagaaatccactggcctctgactcctgagtgttatcattaaagacatccgccactgggaagctctttatttttatttatgtgtacatgtgtgtgtgcatgatatctgccatgtgtggtgatactcttagaagctagtagggggcactggctcctctgagttataggtagtatgagcaatctgctatgggtgctgggaagccagctctggtcctcaaaactggcagaaatgctctaagcactgagccatctctctagctccctgactaatgcttcttgatctaccaaaaccaatcacttcctctggcatcaaggaggtcttggtctgtctgaggagaataagccattgctacatgcggtaggaaggatctgacaggaagaagtctggggaggcaaaggaacgtggaggaagtcagctcagtttgagaaagagtggggacatttctagagaaattgatgagtaaggagaaactgagtaacgattagtcagaaaagaagagaggaaggcgagcagcaatgagaaaggcatgtgatgcattctgggaacttaacaccttagcaactagagctcagggcgaagaaggaagtggtatgattccaaggtagagggggaagcaagggggtgagcaagaactgggtaagggaggcctggggtctgccttttcccagagaatgttacaacctttcaaacatcaaagggagagaaaccaatttatagtctagaaaattccgtaggaggcaaggctaaacacacatctgcaatctcgggtgtttgtctgtgatgggagggttgtgttcaaaggcatcttgccatttagccatcccctgggtcagaataaagaaggaagggatgaagggagggaaaagggaatgttagcccgatggtaggggaggagggtgtcgggaggagggagaaggggtgagctggggactggagagatgacttggcaattaagagcaatcatgaggactggatttcaggtcccatcacctctggagaacgtgacaatcgcctcttctggcttccaagcacacacaggcacacagacactcctccctcaaaatgtattcattctctcatgaacatgcatgaaagggggacaggacggttcactggagaaaggtgccagctgtcgagtctgatgatctaagtttgatcctgggactcacataatggaaggagagaatttctacacgttgacctctgacacaccccccccaatacatagtggtacacatgcattctaccctacttccacatacacaaataaataaatgtttaataagaaaggttgggaattggcagtggggaaagtagtgtgtactacacacacatatatacccacagtcacagacacacacatacacccacagttccacacaaacacatatacacccagtcacacacacacacaaacacacatacatacatacatacacagtcacacacacacaaacacacacacaaacacacatacacaaacagccaaaggggctcctttggtgactaagccggtgatcagggaccactgcagcggcttaagaaaatccctctttctactgagccaccagtagcgttcctcacaaggactgcatattgtcggagaagctggccagtgcaggataggaggcccagatttacactctatggatacagcccccatagggagcccacaggaaaggcaaacaggtcttgctaggtatcccacaaaagcacttttgagtggaaataaaacctccttgtcctgtcaggagaagaagtccccaaacccagatgaggctagaagcgcaagaactttgaggcaaatgctacttgtgggtttttttggttgttgttgttgttttctcctcttctagacaaagccattgggttcagtggtccctccggaaggccagtcatttcctgaggagatatcaggccagcccagacctcattgttcttggtttccagctatggccgccattacctgacaagtaccagagctggtctctgcgcgcctggagaggttgtcagagttgtttctgcttttcacacagcaggcttctggtctgtggcaggcaagagaattctgcccctgaggcatggccggaagacagaactagctgagtgcttcagtctgcagaagtctttcaggattcagctgaggtgggcctcagtcggcagacaagatgctcctggctctgggactcacgctggtgctctgtgagtttctaacctgcttccttcttcccttcttatgagacttgaattcgtgaaatcaacagattggctttctttttctttctcttccagatgcaagcctccaggctgaggaaaactgtaagtcctggtattttcacatggcttccttctttgtgtcttttctgaaattaactcatgtcagactgcttagggttggtgtttacaacaactaagaaaactctcaaagccttgttctaaatcaaggttcaaagagtgtgtattagagacagcggtgtaggagaaaattgctgaacaccagtcttacatcttggtgggtttctgtttgttggaatgggagagatgggtttttttaaaaaaattccttatatgtatatatgtatatatatgattccttatatgtttgtggtctttctgtcataagctatttctttttacatcatactatgcctctaattgtttactttcaaactcttctctttattcgcttggatttagagtctgtaatcccagtacttggaaaacagacacagaaagatcagtagtgaagtccagcttcggctccataggagtttgagggaggcctgagctactacgtgaaacagtacaaaaccgactcccaaaaaataaaaacttaaaaaagtatttttttttcctttcacttgttttaatttacaaatgagactcagttgacttgacagactatggaggctgaaggagcagacagtaaatgggtgtcaggactccctctgtcctaagagagtaacaaaaaggaccagccagatcccctttccctcccaccggggaggctccgctcctatctgagcttgcttgtggggaagggttctgcctgtctttaaagtcagacctatcatccactcgagagctgattcggaacctccgaatttttcagattaagaggatctgtctcgctccgtccatcagagactctgaaggaagaggctcagcccagcccagggattgtgggtcaggaagaaggccacagattacactggctcagtcaaaagttattccagtgtgggaagactagggatgctgggctgcaggcatttttgagctgaagaacgtgacagggctgagttgagccagggatggagctgtggccccaggtggggagggctgtggtctgtgagtctgtgattccttaggcttctggctcccttggcaacacctggagacagactgtgtattgtcttcaagtcatccccactaaagggtgggatgggtgagcctcagaaagacatgactcagcctagaatgtcagggcttgtcagcactacggcctccgctccctggaacccagacatctctctggggcttgtgcttggctttacttagcttgctctggttggggactggggtctcacactgctaaggtagtcttgaacccactgtgtagcccgggctgcctagggactaactctaactcctcttgccttagcctccccaatactccccagcctggtgtcactcagccggcttggctttgcttcttgggacctttttcccctgactataaaatggaaaccacccacagacctggtggctcgagcagggtaaagttgagattggagtaagggaggaggagtcatttgtgctgtctataggattagtaaatgatcccgggcaatcaccccagccctcctttatagtttaaatttgtgccctatttgctctgtacccttccgtgccccctatccccactccatctctctcttgccctcagggtgtcatatacctgaaacccactgtgtagctcagatgacaatgactttcaggtcctcctactttcctctcccaagggctgagattataggcacacaccacaccaggtttatgcagcactggcagtcaaacccagggctttaagcatgtgaggcaagcactctactgactgaactacatcccagcactctctgtctcctgtctgggttctgccctgccagccctagagggttcttgcatctcaagatccccatagcttgtctcccatctctgtgtctgtctctgtctctgtctctgtctctctctctgcttcacaagacatctgctgtaagaaacatggcccagagaagcaggcaatagactgaagttgctttgttggaactggaaggagcctcaaccttccccagggatgaaggatgaggggctggggatgtgtgtgtgtatgtgcacacgtagtgcatatgtaggggtgcgtgtgtgtgtgtgcatgtgtgtatatgcatcactaccaggaagttacagctatttttttgtagttggactggaagcagggtgggttctttttgatacttgggcaccttgtttctgcaggtggagctgaccagtcaggctggggcggagccattctttatggctaggactattgcccagtgcagcctgacttaattcctcatggcctgaggctattatataatatattcccaaatatgaaagggtaaaaagaagaagggggtggagctgggcatggtggcacaggcctttaatcctagcacttgggaggcagaggcaggtagatctctgtgagttggaggccagcctggtgtacaaagcaggttccaggacagccagggagggctattacacagagaaaccttgtctcagaagaacaaaagaaagaaagagaaagagaaagagagagagagagagagagagagagagagagagagagagagagagcacaaaggcaggggtacagagggagggttgtagttttgggagggagggcttcttccagctagagtggggtgacagtcccagtggtggaaggagcatgctaaggtcccttccaggcaagatagtggttagtagtttttagccatgaagggccgagtgacccgttgaaagaacttttggtgagacagttgaaaagacagagaccaaagagccaagttagtacaaccataatgattgagtctgccaagggggtgaccatggcccccaagtagtccaggtgtcctcaaggaggacattgcttacccttccttgctgttggagtctttctaggaactgttcaccattttcccatagtacaccatgttggtttgcttagaaatagccttcttcccctgggaaggcacagatgccttgctttggaaggcatcattaagcctagtcatccacacttctggaggacactgcagccagtgtatctatttgattttggtaggatgactggtttgttgtagcaagattaggtcttccttaatccgattgatcatttgagggtgttgagccctatcgcttgccgtagcgagcgagccattgggagggctttcctaggacctcttgttttagtagagagggaagttcagagcgtaaaaatacttaaaaagagttctgtgacggccagggttacacacagagaaaccctgtctcaaaaagaaggggggaggagggagaggaggaagaaaaaagaagaaggagaaggagaaggagaaggagaagaaggaggagaaggaggagaaggaggaggaggagaaggagggggagggggagggggagggggaggaggagtggaaggagaaactagtcagtgctttggtgatcaccttcagccttcgaaggaaggtgctgacatccctatacagactagaacaaaaaaattgcagcctgtgagtgagttcatgggggctttgagatgggaagggccccttgattagtttagagaaccatttccctcttgcatcagctccacaaggtagaagtaggcctaatgaggcgcctgctgacccctctgatccctgctatatatatttttttccatctaggccactgagattgagctctgcagggtcaaccctagggataagcaagcaagccagtgtcttgcttcctaggctacccaagtggagtatgtgaaatgtaggttttgcagtttttctagtttattttcccccactctacaagtcaggttcttgctaagcgtaactctttttttctcaggcctcaggtccacctcagcctgcctctgcctggagggaactccctggacttcccgcctagtcctggccactggctaatctgccttcccacccatcctgctggctccctcccgtgtcagagcgcaggcacattccctcaagctgaccaggcccctgctgggccacctggacctgagcctatacctccttcaccacaaggacccccagccctggcccccagttacttccactctcggtggacctctgaagctagtttagaatggccacctctgcttcctctggtcatggcctctctgcctggaatctcagctccaccaaagaccacctgatgccaagccttttccatcccgtaacttttgctgcccttgtctaaagatcataaggggatcctgctctcctgactaaggatttccttccgtttcctctccctcgtaaaccctctttccttgccctcaagggagactggttctgcccagccccttcctttcctgtctctagagcctccgggttacagtgtctccatagccagtctctgtcttctgcatgtctccgtcatactggtctctcccctgaccctcaggctttaatcctgagcctgcagtatgtttatctgccaggccttcagatttccccttagaagcaaagccttcctttttcactcttttacctgacattatcagtagccagcaaactgtctcccatttttcaggtcccatagtcaatcaaattaggcattgaaaagttgtggtaaaatataatctaaagtttatttttttttaaatctgtattcatctatttatttttgaggcaaggtctcactatgtagccctggctatcctggaacttgcttatgcaggccaggctgggctggaagtcagagatctgcccacctctgcctcttcagtgctgggattaagggcgtgtgccactttgcctgcctttaaaatatatcattgacatctagagcacgtacagcctcgtatagttctagaaggtttccatcactctagagatgaagccctttcggttctttggagaactctcttagctcagcccacctgcctgcccctcccccgccgtttccatctgatccgcccctggctactcactagcccctggctgctcactggcatggagtctgaggccatggtgatttttctagaactccggtaacttctggcattaccatcctgacccacctgaccccttctctcccacactccgctcctgaaactggccacgcccagagtgcacaggtgttttatgctcctgttcctgatacacgctgttctgtgttctggagtacccaacagctggcctgccgctggcccagtggactcgatcctcccctccccccgcccccgcacatccagcacgcagtccttgccctctcccgggcaatcccttcctctctgcataactgagttatagccaattatccaccagcctgcgcgctcaaacagcaggagtcatttcttatttttcctggacccccccccccccagtacccggcacagttggataaatgtcacatggctgggaacttgaagtgaacttggagatgcctgagagtccccagggcagatgggccagcctgtcctgtgatagcaaggaagtgcctcagggcttccaaggagctctgtaattttcctgacaatggtaggtagttcctcttcccctctgagtcatttccaggttgagagccaggtggctgggggtggctcatcatactaagaggaccttaatttgggaaggaagccccctcattaaaccgttagtatttaacattgtttgtacccctcctcctcccccccccccaaccccccagacannnnnnnnnnnnnnnnnnnnccccccagacagggtttctctgtgaagccctggatgtcctggaactccagtttgtagaccctcctctcttagatctctttaggctgttctgtgccctgttggccattgacttttttgaacagtttgaggcttgatgaggagcatggggtgggggtgggggcattgtccattgacaggaggtctgtgggacatttccaatactgtgcacacctagagccttgggcccccccttgccgtgaatagtcctgtatcctggtgagacctctgtgcagtttcagtgtgcttctcctcggagggcatgttcttatagcaaggagtaagaattctgttttatagacatggagaagtctcaagatctgctggctgtattattattatattattttcttatagcaaggagtaagaattctgttttatagacgtggagaagtctcaagatctgctggctgtattattttcctgtttgcttgattttgcaaaatcaaagaccaaagaacaggactggggatatgcctcagagttcatctggcatgtgtggctccctggttttgatccctaaagccacacatggtggtacaagcctataacactaggacttgggagatagagacaggaaaaccataaagttcaaaatcctacctaatccttggctacatagtgggttcatggccagtttgctctatagaactattccaggacagcacagagaaacactgtcgcaaacaaacaaacaaacaaacaaacaaacactcagtgcagtgcttcctcagagagccgaacctgggaggttggactttctagggctgccaaggttacagagtggggagtgcccagccaaactcagtatctttgtgttaacagaaaatgaaaggggctgggagaggggtgtgccagctcacactgtagtccccgtacttgggaaaccaaggcaggattgtgaagagtttaaggctagcctgagctacatagcaagattatcttaaaataaacaaatatcttttttaaaatcttgaattattccaagactctggctggaagtagtataaactcagcacctcacccagtcttgtgggtaactctggctcacaatcttgtgatgatagacccttttggtcaaggtcaaagttgttccacgaaggctgactaagcctgggtgtctgcttttgagctgacttttgtggctacactgaaggcctccgttcatcatcctgtgagacaccgccttcttagctgctcttgcaggatgtgacttttgacccagggctgaggtcctggaggagagagcttgactagatggaagctgtacactaacatcaggaggagtgtcctggctccattgggggagtcagtcctgtgatagccttggtatggtcatgtgggagatgtaacagggccgagggctgttttggaggctgtctagggcagagcggctgccacgttatcgaagctggttatgttctccgttagggcttggcctggctcatttgggaaattttctttatttaaaattttgaatgcatgtttatttagtgtgtgtgcctgagcttgtgtgcagcctgtgaggtgcttttagaggtcagaggataacttgcatgagttaattctcttctaccctgtgggtcctgggattccacaaactcaggcacagcagtaagtacctttgcttgctaagctgtctcaacggccctatttttatttttatttatttattcttcatgtgtattagatggtcgtgagctgccaccatgtcagtgcatgaaatcctagttctgcaagaacaagtgctcttaatcaccgagccatttctctccccgcacccccatctccccttgaggcagggtttcactgtgtaatcctgcctggcctggaatttgcattgtagacccagagtggcctcaaactcttggcagttctttcttctctgcttccggagcgctagaattagaggtgtgtgccacagcacctggcctcttgagttttctacaaggtttccccctcttccgtcctgtgatactcctgctggctgagtggcgacatgaggttcctcccagtgatccaggtgcgtgttacacaagtggatgtgtgtcaaagaaatcagccgtgtcaataccaccctccttacaaaagccacacattggctggagagatggctcagagattaagagcactgcctgctcttccagaggtcctgagttcaattcgcagcaaccgcatggtggctcacaaccatctgtaatgggatctgatgccctcttcttgtatgtctgaagacagctacagtgtactcatatacataaaataaataaatcttaaaaaaaaatccacacatgccaagtgtggtggcacatctcttaatcccagcactcaagaggcagaaacaggtggatttctgtaaattcgaagccagcctgatctaccttaccagttccaagccagccaagatagtgagttgctgtctcaaaaacaacaaaaagccacacttggtgctttaattgaggtttttttgtttttggttaaacctagaggacagttcgagtttgagaaaaatgacagaacagccaaattataaaatttcaggggaatgaaggagagagcaagccatgccttttgcaatggggggtagcgggcagcagcgaggcagagagcatgggggcctcggaggctgatgctcagggtatccccttccagactttgatcactatcagggggaagaggaaatagaaaaggagggaaatgacaaggccggagttgtagggtgggatgcttcagatagctgctcacagctgcctggaggccggagacttcctttcaaagaaagacaagtcccttctagcatgtctttatttaggtggaaccgaattccctttggggaagcattcctgggattccaactgatgaactgggctggttggattgacagtagggaagggaagatagggatggcacaagagttaagagttcttactacttttgcagaggaggggtgcccagcagccatgttgggcagctacaactgcccataactctagctcctcttcagggaatggacacccctttctagtctccttggacattgcgttaatgtacataaacccatatgcagaatacacacatgcacatgataaaaacgaacaacggaaggaacaatagtatgaacagtaacagtatgtaatgttttgtttgatcttaattcttttgcatctattatgaagtggggggggggggcggagggcgtgttgttgacccactcagcactgtggacagtgcctggcctggagaggcccctgtagtgtttcctatagttgtcctgcaatgtgaaggagagaagtgattatccatgaggcccagggtttgttattaccacgggcaccttgcctcagtcaccaaaaaatacggaggtaggggagtggggctgggtaaggtatggctcagtggccaagtgcttgcctagcatttgaagggcactggcgtcaatttcctagcatcaagagaaaaataattaccaagaaatgcagatgtgctagcattcctgtttcaacaaatagaagcaaaaagactacaggaattaaaaataaaaaaaacaactacttccaaatagccaggcttagtggtgcacacctttaatcccagcacttgggaggcagaggcaggtggatttctgagttcgaggccagcctggtctacagagtgagttccaggacagccagcgctacacagagaaaccctgtctcagaaaaacaaacaaacgaacaaacaaacaaacaaacaataataataaaacaactctcaaccctatctagctaaaggagactgttcaggatgctgtctgtacagtagcccataactagggtggagaccacacagtatgagcaagtctgggagcctaaagaacttaccaatttctttatttctggcagtcctgaggaccgagccgaggactttatgcatgctaggtgggtggtctactgctgatccacatccccagtttggagactatgttgttacaaatcgttctgcatttaataaatttctagaaacagagaagagatgaagctttgaaactcccatttattctgtgacagatagaccccaggtaccatttcccaggcgttttcctggtgctaagaacgatgctgtgtctcccggagggtgtgtgatgcttgccaagtatgctacactcagagttgtaggttcactcctcagcatctcataagccaagtgtggtggtgcctgcccgggacccaggaggataaagggctcggggtcatccctcacgacagacaggatgcaagtctgggctgagtgggtcccactgctgacaactgtgggttgagtaactaacggcccttcccacagcagagctggcctgtggccgctcatttcctggtaagaggtcaaatcttgagaatgtctcactgggtcgtttctgaatttctctattttatgtgtgtatgaaaatccacagtgaatagtatagcataatttcatcatttccctgtttatattcatataacctcttggaggacataaacccatgaaaccttcacaaagaagcaaacagggcatgaacagccatctctgctttgagaagttggtacatgtggaacctccagttagatgctctatttacacaacaacaaaacccaaccccaccccgagaggggggctcattatatagccaatctgaccttcgacttctcccactgagccctggccttggctttatgtgttgttgttggtggtggtgtttttgttttgttttcttttttcttttgttgttgttgttgttgtttttcaagacagggtttctctgtatagccctggctgtcctggaactcactttgaagaccaggctggcctcgaactcagaaatctgcttgcctctgcctcccaagcgttgagattaaaggcgtgtgccaacaccgggccggcttgttttgttttttgaggcagggtctcagtatataggccaggctagcctcagacttggtagcccactgctgaccttgaactctcagtcttcctcccttaacctcaccagtaactcagtgaaattagagaacttttggatccaagcaggagacaaccaaagtccgttggtgacttctgaggattcggagtctcgcaatgagtcagctgtgctcactggcctagctcttgtctagcgctgggaatcccagctctcaggttttattttcactatctcttttcctggtgctggagtggaacccagggctcacatgcggcaagcagatagaaacatgccctcttctcctctctaagacaattttgtgattgttgggttttgtttgtttgaggggggggctctgttcatttgtttaccactatgttaaactgtttgtgtgtgtgtgtgtgtgtgtgtgtgtgtgtatgtgtgtgtgtgtgtttgtttgtgtagacagggtgttagtttcttctttactttcttttaaaaattcatttggaggaggacagctattccacacgtatgaaggtcaggggataacttgatgatgtgggacctctcctttcaccactggcttccagggattgaactcaggtcctcgggcttagtggcagatgcctttgcctggtgagccctcacacggtcccttttcgttttaaatgtagtgctggggattgtacccaggagtttcattgcggatgttaaggaagtactctatcaactctgtccccggccaggcagggttttactttgtagctcaagcccttgagttcacagtatggtagtcatggcctatggatagtttcctcttaccaggtaagaacaggacttttagagagccttatctaagccatggaactctatgtttagctggcacaacttctctgtacctgtcttgttagagtttatcactgcaatgagacaccgtgaccacggcaacttgtatgaaggaaaacattcgattggggctggcttattagagttcagaagtctagtccattatcatcatggcagggagcatggctgcacacaggcagacatggtgctggacaggtacctgagagttctacatctggatccactggcagcaagaagtgagactgaaccactgggcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagccccccccccccccccaatgacacacctttttaaacaaaccctcacccactgtggggccctgaaagccatgcaacctgctgaactcttctggagtaagagtgagatcaaaattcattcaaaacccaaaaatctcatccctgaggccaccaggagcaggactgcttcctccctgctctgggctaacatgtctaggcagtgtacgtagccttgggaccccacagtctactccagcgaggcctcacctcttaatggtgcctagcagtacctggcacctaatacctgatatcctccaccatctctggtccttgaatttctcacagccacatgcattttgggtttcccctggtcaactgctaggcttgaaggtgtcagtcaccctatgtgtggtgtgtagcatgctatctcttgtgtaaacaggccagaggaacttcctctttgggttttcttatgtgtacatgtatgctctatgctcactgggagcctcctgcctcagtttcccatgtgggattacaggtgtgagtcagtcactacgctcagcttcaaattatctaaaaataaaatcatctctagttgttgttgtttttttagggtttatttattttatgtgtaagagtgtaagccttcatctgtgtctctgtaaacctggcctagtgatgcacgcctcgatcccctcatttaggacaccggttctcaacttgtggggtcaagaaagaccccttcggaggtcgcatatcagatatccttgcatatcggatatttacattaagattcataacagtagcaaaattacagttattaaataataaggaaagtaattttatggtggtggtggagggttaccacagcatgaagaactgtgtcaaagtcgcagaattaggaaggatgagaaccactggcttaggaggtggaggcaggaagaccagaagttcagtatataagttatgtataatgagttagaggaagtgctaggctacatcaaactctgcctaaaaaatacaataaaataaaattggttccaagtcttccccagcaggcgacacctctaaagtgggtctgtgtcctccccgccactggtcacaacctcttggggaggcagatgtggagagtttgactgcccttatcccattccagtgctagggtgggtgctcagagacatcgctctggggtgggaaagcacagtcttaaatgtgggaatgtgggaaagtcggagctggttccatccctggagcaggcaggggctgagggggtcttctgactcttagacacccaggcgctgaggggaatgaaggaggaactgagaactgagtcaggggccctcgggctggggacagtgtctagcctggggtggaagtgggggtgggagcactggcttatcccagcggtgtttggaggcgggcttggtggcagttgtggctagaagcacggagaggccttctgtggtagaattaagctgtgcgttcatagtcaaatgtcttctctgtggttccccgagttggatcttgagggaagagacagtctgtggttctaaacagtttattgttccttcatggcaaaaaaattagatacataatataccatgcccagttctcagggtggaccttttacagggaggaacgtctgggaagggaagctgagtggctaagccctctgggcctctaggtacctcattagcatagagagctctgttttgggcctaggtgacccttggacacgtttcttttctgtgaggagtgtgttccaggccaggagtctggcagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggtccgtgtctctgagcgatgctgtttctgaagtaacagtgtctgccatccttctgctttgcctcagccttcaccatcaacagcatccatatggaaagcctgccatcatgggaggtgatgaatgggcagcaactgaccctggagtgccttgtggacatcagcaccacctcgaaaagcaggtctcagcaccgggtgctgttctataaggacgatgcgatggtgtataacgtcacctccagggagcacaccgagagctacgtcattcctcaggctcgggtcttccactccgggaagtacaaatgcacagtgatgctgaacaacaaggaaaaaaccacgattgagtacgaggtgaaggtgcatggtgagtccgcaagcagaatagcaggttgatgatgatgctcacgttggtgacgctggtcacgccgctcatggtgacgccagagaccggccagtgaagctggtttccttctccgctaagctccacctttcctgttcactacctggcatcctgacctgaaactgtaggctttagaaactcccgctgtgtgaagacaggacttcctcctttgggatgatgtcctggccttgggaacacccttcctcatcctccttaagtaatagactacatctcccaaccccttctctgaaacagtctccctaaagcccgggcaggcttcagtctcctgcgcatgcgctggcgttacgggtgtgggactccacaccccgctacagagttcttcttgcacgttctcaacagagttgatttctcccagggcaccagtctttacagtgtttatgctcctctgtgagagtgacaaacagcatggttttgtcacatgaaccaaaccttggtggtacacacctttaatcctagtactctggaagcagaggcaggtaggtctctgtgagttcaagatggcctggtcttcggagtgagttctagaataaccaagctacacaggggaaaccctgtctggaaaaacagaacaaaacccactagactcaagtctctctgctttagtcaccatctggatacgtccaatagccattctaaacttcaggggccacagaggtacctgggagattaaagttattgctgtcaagcctgccaatcgtcattcaatcccctgaacccccatggcagaaggagaggactgactcccatagtgtcccatgacctccacacctacaccatagcactcttgggaccacacataagacaccaaacaaataataagtaaaatctaacaggagcattaaactctggaatccgcagggatgaagtgaaatagcaggtagtcactcagggactcggcatgattgagtgcagttccctgtctgttggtgttcagccgcttgaggtacaatacttagtccatggtgaacaacacaggtcatagtgggcccatgaggtaaacccacgaggtaacctcgtgatgttatgccatcttggtctgtgcaaatttactctcttcctggaatgatgccacctcacaaagcatttcccaggctgtgtcttagttgttgtgaaacaatctgtgtccatttccccacatctactgctctttggggctataaaatctcagagagattaaatttggcctatttccagacaggcagaggttgttggaaagcgcatgcctttaatcccagcccttgggaggcagaggcaggtggatctctgagtttgaggccagtctggtctacagaacaaactccaggacagccagggcgacacagaaaaaccctgtctcaaaacaatggcgacaacagtgaccactggcctatttttcatatcctgggtaaagacccaggcttgaggtaggcattcaataagttgcaacagaggccagagagagctcaagccgtacaaagctttccactcagactaaagacaggagtgtgcagacacccagtatccacggcctgggacgtgcctgtaatcctgcaactcagggtgtggagagacaggaaggtccttggggtttgctggccattcagcctagttgaattagtgagctacaaagtcagtgagagatccatctcaaacagaaaggtggagagcagctgaggaagatgtggcctctacatggaagtgtacacacacacacacacgcacgcacgcacgcacgcgcatgcatgcatatagacagtgaaagcatcagctgaagtaacataattaaatactgactttttttttttttggagacagagtctcactatgtagccctggctgtcctggaacttactctgtagaccaggctggcctcgaactcagagagctctgcctgtttctgcttcctaagaacgaggatgaaaaggtgtgcatcgccacacctgggtttttcctttttaaactgtaccagttgggaatctagttgcaccaccttccgaaggggatcgcaaaccattgagaacactgttgtattatagttttaaactgtctgctacagtgccaggcacacagatcccctggggtaggtaagactgaatcttcagggaataaagggccctgatgctgatcagccacagtgacagatgagggtgatggggccgttatgcggaattgatcctaagtgtactttctccttctccaaaggcgtatccaagcccaaggtgacactggacaaaaaggaggtgacagaaggcggggtcgtgacggtcaattgttccttgcaagaagaaaagccaccgatcttttttaaaattgaaaaattagaagtggggacaaagtttgtcaagcgaaggatagataagacctccaacgagaactttgtgctcatggaattccccattgaggcgcaggaccacgtgttagtgtttcgctgccaagctgggatcctgtccggattcaaattgcaggagtcagaacccatcaggagtgaatacgtcaccgtgcagggtcagaatcctgccctctataccattctttgtagtgacgggttatatgtagccaaaaggagcccagaattggagaatctgcgcctcctttaaggctgtaatcccagccctggtgaagtacaggcagggggttcaggggttcaagactagcagccctcagctaggcagtggtggcgcacacctttaatcctagcacttgggaggcagaggcaggtggatttctgagtttgaggccagttgaggcactctggtctacagagtgagttccaggacagccagggctacacagagaaaccctacctcgaaaaacaaaacaacgaaaacaaaaaaaaaaagactctttctcccatgagccaaataaatagcattaactgaaaagaataagtagggcgctggaatggcagctgggagtgacggtgcaggcctgcgatcccacctactcgggacactgaggcaggaggattgaaagttcacgggcacgctgggcagttgagtgagaccctctcttaaagtaaaaatgaaagagaggactagagatacaaacatgtggtgagatgtttgaccagcatttgggaaaacctatgtctactgggggaggggccacaggaaggggagccaaaagagcgaaaaaggactaagcaaatggctcaggaagtagaatgaatttgatgccccaaacacgtgtaaagctgggtgtggtggtgcacgtttgtaatcccagccctagagagctagagacagacagattcctgatactcactggctggtcagcctcagcctagatattgagccccaagccaataagagagtctgtctcataaaaaaccagaccagggcaaagggggctagagagatggctcagtggtcagcattcttgctgtttgttcttcctgcctttccacacacatgcaccagaacaccacgccccccaatacacaggcgtggctccgcccacccagataatagactagaaagtgcccagttttgaacttgaatctaactggcttgtcatctttcttgtagagtccttctccactcccaagtttgaaatcaagccccctgggatgatcatagaaggggaccagctgcacattaggtgcatagttcaagtgacacacttggtccaggagtttacagaaattatcatccaaaaagacaaggcgattgtagccacctccaagcaaagcagtgaagctgtctactcagtcatggccatggtcgagtacagtggacactacacctgcaaagtggaatcaaaccgtatctccaaagccagtagcatcatggtcaacataacaggtaggactgctgagggcgggcaggcaattgtggctaggtatagttcttcatgtctgtaatggcagcatttgggggtaggggggctgagataggaggatcatgagttcaaggccagcctgggctatctagtgagaccctgaccagtgagtgtgatgccttttctgttccaggttgtcttgggtgtatgcatgctgggtgctggggcttgtgggaaggattcgatgcatagtagtcggctatactggctatacattcgttcagaggctggtgctgactcaatcctgctgctcactacttctgtgctcttggctgaactcttgaacctgccccaactgtgtgagacccaatggggatgtgatggtacccaccttatagcaccatcacaatgtccgtttaaatgaggtagctgtggtctgcatccaagtgagcattggctaatatctctgcaggtgtctgtgttgtctttcctctgagccaaactcttcttcatggcctctttacgttttttaaattttatgtgtgtggatgctttgcctgcatgtaggtctatgtaccatttgtagacttggtgtccatgagggccaaaatagggtataggctgacctagaactggagttacagttggaagtcaccaggtgctgggaattgaacctgggtcctctgcaagactagccagtgctctgaagtgctgaggccaaaccccagcccaaatctttttctaaaaggttttggggtccaggagtcaccccacaaaccacacaaacactgatctcagtcagatagggctgtattgaacatataccctaaaagactgatcaatcagggccatagttcaaattttgggggctgagtctacgaccctcaacattttttctatgtcagtttataaagactaagaccacaaaacccaccaatgagcacatacgaagtgctggaagtcctgcccagtggtcggccctgactcaagccattttagacataacagttcatactgacctttaatttgatgggtcctaagtgacacttatggttgtggattttttttaaggtcacccaacctcataacatgcaaaatataatagggtatgtggtcagcaaaaccttgctctgaataatttctgcaccaatgactggcaggtgtattatagcaatagtcagcaggaacaaaatggctgcagctatgctagggggataggtttcaaaaaaggcattctctctctctctctccctctctctctctctctccctccctccctccctccctccctccctctctctctctctctctctctctctctcttgttgcacacgcccaactggccaggaagaacgacgctgctacaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgtatgtctgtgtgcatttatatttactctgtgtgtgtgtgtgtgtgtgtgtgtgtgtgtgtgtgtgtgtgagagagagagaggctgagatcagaggatgtcagagcctttggaagtggagttacaggtagttgtgagctggttgatgtaggtactgggaacctaatccaggccttctgcaagaatagtaagtgtggcctggtgtggtggtgcacgcatgcccagcagttgggaggcagaggcaggtgaatatctgagtttgaggccagcctggtctacagagtgagtttcaggacagccagggctacacagagaaactctgtcttgaaaaacaaacaaacaacaacagaaagaatagcaagtgcttttaactattgagctatctctctaccttcctccgttttcttaaagacaagatctcatgtggccgaggctagcctttcacttactgtgtagaggaatttgtccttgaactcctgaccttgctgccttcttgcaagtcctagggctccaggcgtgctccaccatagcaggaactgcccagtgctaggtctcctgaccccagttctcggctttatctctctaaaatacttacactttgactactgtactctttcttgtttgctgtgctgtgcattcagctgttacaatgtaagcagctgagggctgagaccttaactcttctgctcagtgctatgtccttaacttgtactatggttagtcagaggattgggctgagccttgtgttacaatgtttccaagagcagagtcagcacttctcttctgttgaaagtctccattcataaaaaccgtcctcagttcattcagtagtttccccccaaatccccaagtgtcaagctctgaacatgcggtcacagccaccacccccaggcttataataggtaggtagaatgccaactcatcaactaggggattggcacactatatcagatcctcctggtgtagggtgtgacatcatgcacaatttagtgagttatttatttacttatttacttatattttttgagacattctcataatgtagcttagaactcccctatgtagaccaggctggtccctatataaaactcaagtgctgggatcaaaggcatgccccatcataccaagcatggattattgataatgacaaacatttggagtgctcttgataaggcatacattctcttgttagagaaaaaagccatcattcatatatatatatatatatatatatatatatatatatatataaactacatattataatacatatgatatatatcatatacatatatatgacacatccttctgtatactgggctgcttactaagaattgaggacttcagatacaagcaggcctgtcaatgggggtttcttcttgccataatgaacttgcaaattttaaaaaatatttacttatttattttatgtatatgagtacactgtagctgtacagatggttgtgagccttcatgtggttgttggaaattgaattttttttttaggacctctgtttgctccggtcaaccccacccgctcagtccctacttgctctgtcctaaagattattgtatagtagctgaccagacgcactagaagagggtgtcagatctcataatggatggttgtgagccaccatgtggtttctgggatttgaactcaggacctttgatagagcagtcagtgttcttacccactgagccatctcggcagcccatgaacttgcaaatattatctaatatactttctctaggtaaccacctagagcaacttccttccaaggactgttcccttaacccctccagggtgaagttcagtttcctctctgtgggctctgctgcaaacagtattcctgaattgagcgttagatataaattccttgaagtcagcctgtctcacatgctgttatctttccattggccagcaaagggtcaatacttgtggaagccatgcatagcagtgtacacttgtggtcccaacacctgggaggtagagatgggaggaacagaagttcaaggccatctctggctacatagttagttcaaggtcaacctaggctacttgagaccctccctgtctcaataaatgagtggacagatgagtgaatcctcataggaaatgcaggaagagccagcagagagatctcaaggtcagagggagtcctgtcctcactcttttgtttgtttgtttgtttgtttgtttgttttttgagactgggtttttctgtgtagccctagctgtcctggcttcttttaaggccatgctgtcaagtatatgagaagcagaggaagactttttgcaggttcctaagggttaattctgctgaaagtaactgggctacaaatgtctgcggctgaggactgaggtggtacccagacacgtttcacctcccttcccacttgatgttcttcagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcggtgagtacactctcagctgctcagatatgcaaaggttgggtagggactaggagcatgatggtcagttagctgtcaccaatgcagtcgcaaaggctgatcggattcaggcaggtcgagaagaactcctgggagggccaggaaaatggcttattgggtaatggtgcttgctgcctagcccggcaacccgagttcagcccctgtgatccacgtggaggaggcagagaaacaagtcctacaagctctcctttgacctctgtatttcatctgtatttgtgtgtgcacgtagaacgcacagacttctgtgtatatctaagacctggttacgaggcatgtggtacatacctataatcctgacatccaggacgttgagctagggattgttgtgaattcaagaccagcctgggatacatagcaagggcctgtctcgatcctccttgactcccaacataaaaaaaaaaaaacaacaacaaaaaagtattaaaagaagaagattctagttgggtattggtggtgcatgtcattaatcccagcagtgagtttgctggaggattactgcaaactcacggccaacctgggatacagggcaaggtcctgcttaaaaacaaaacaaaacaaaacacacacaaggggtctaaagagattttccagtggttataggcacttgctgctctttcgaaggacctaggatcagttcccagcaccacatcatgcataagccaccacccctggatggtagacctacaggcaggcatgtaccaccatccctggatcttccacctcctgtctccctccattatcttcctttccccaccctccccctgacttcctccttttgagacaggacaacattatactatggagctcaagctagcctcaaatttgcagttttaccgcctgccctcccaggtatggacctacaggtgtgttccactacacccagatattatatcattattttgcttataaaaatagatattttagcagggcagtggtggcgcacgcctttaatcccagcacttgggaggcagaggcaggcggatttctgagttcgaggccagcctggtctagagtgagttccaggacagccagggctacacagagaaaccctgtctcgaaaaaaccaaaaaaaaaaaagatattttaagcagggctgtaatagtatactcctttaatccccatactcagatagtagaggtagacagatctttgtgagttcaaggccagcctggtctacagaactagttccaggacgtctagggttatacaaagaagccttgtctaaaaaaaaccccaaaccataaacaacaggaatgattaataaatcaaaaacaaaacaaacccaacaaaattagattttatatatatataaaatttatatttatatatatataaatttatttatatatttatatttataaaatatataaatatatatatatttgctgttctgacacagtgtctcactatgtagcctggcctcaaactcataaagttcttcctgtctccactttcttagtgctgggaattgaactcaagactttacacatgctaggcaagtgctctaccactgggctacatccccatctatctacagcagttcattttctcccttgtatattgcacacacacgcacacacactcatgcacacacacacacacacacacacatcatgcacacacacgtatagacaagcattgcctggacaggccacagccctataggagccccttaagatggataaggcaggcaggcaggtaggcattggaaatcatgatctcgattgggaaagccaagctcagagttttcagaaggaaggttcccggctgggttgttccttgtgttttatttggatttcccctgttgttgtagaaatgctctcgaagcccagtatttttcatgatgccaagtctgagatcataaaaggacatgccataggcatcagctgccagtccgaaaatggaactgcacccatcacttaccaccttatgaaagcaaagagtgacttccagactctcgaggtgacctccaatgacccagcaacattcacagataagcccaccagagacatggaataccagtgcagagcggataattgccattcccaccccgcggtgttcagcgagatcctgagggtcagggtgataggtaagcagctgtcttctgtgaagcaaaggtagggctcaaggctagcaaggctagggactgtggccatcacaaggatgctgcctgtgcaacccatagcagatatgtatcaaagaccaagccccagatggtgggtctgagcaatatccggggtttcttgatgtggccgttgtaaccctttttgaccttccaagtgacagttgactgctggtattatgtagttgggcttccgtggtttgagggggcggggtgcttttcagatgaagagagagctgccctcaagaactgcgggcttagaactctttccttgctagtggtcttagtggaacatctgtgtcacacatgaaacctgccacaggccttgctgcagaccatgggctcatggaaatagctgacattagcctgggattctcaccatggtcttggggttggatatcttttcctcgagcatctgacttgtgcctttgggtggcttgttgcagcgtcgctgcccccactgcttataagactcccaatgtgccttctcctctgtccttcagcagcttttgtttagcagctctgtgtcgtcaacaggcagtttataggtgctggagagatggctctgtggttaagaacattggctactgtttcagagatcctgggttcaattttcagcatccacgtgacagctcacaaatgttcctagagatctgatgccctcacacagacgtacatgcaggccatacactaatgtacataaaaatgcatcattaacatgcagtttataattgtatactgtgtacctgtgctggtgtgggcgagagttggctactggtacagggtaagtggtccaacaagcctgtaatcctggcacttagtaagcagaggcaggcagatcaggttatccttatctacatagtgagatcaaggccacccaaggtcacataagacccaagtctcagaggacaagggagggaggtggggcataataagaactggtctgaggaggggcataatatggacatggttgttatgcattcaggctgttgttgaagagtgaagacttcagatctccagatgttaattaataataaattcgtccaggcggtggtggcgtactcctttaatcccaacactcgggaggcagatgcaggtggatctctgagttcgaggccagactggtctataaagtaagttccagggcggccacgacacagagaaaacttgtctcaaaaagaccacagaagaagaggaagaggaaacccgagttgaaattgggtcagtgctagtgacgagcatttactgagcccttcccatgtgcccagccctgggtgaagcactgtggtaaattatccctagtaatatttaaaatagcacatgagactcataagtgaactcactaagacttagagctaaggcacgataggtaggactgggatttgaacccaggcagtgtggctcctgagaccaactcaccactagcctcttgtacttcccggggggagagactgtcaggtctagcagtgtgctcaggctgtctgcccctgtgtgggaccactgccatcccaggcctgatgctcagcttccttcaagatcatacgccctttgtgctcagagaggtgacatgtgtctgtgtgtcactagtagggaaggtggcctggaatggtgacataggaccagaatttgaatggttaggaatgttgctgagggaaggtggcacagtgggggcacagtggatttgcctctctgagcttccaggtgggaaggaaaccatgaagttccgggaagctgtctggacaggaaacttctgtttaggtttcagtgctcagaaataaaagctgagtgtggaagtaaagtctctaagtgaagatggaggggctggtgagatggcccagcctaatgacctgagttcaataccctggaccttacttggtggaaagacagattcctgcaaattgttctcggagttccactaacacacccatgcacagaataaataagtaaaaaaaataagtaaaaaacaatgtgtgtgtgtgtgtatatatgtatatatatatatgtgtatatatatatatatagatagatagatagatagatagatagatacacgtatatacacacacatatatatacacacacatacgtgtgtgtgtgtgtgtgtgtgtgtgtgtgtgtagagtggagttggaagacttaggaccaacttttcagaaaatccaaacccatatttcattgccaaaataagtagtgaagaaggcaggcagatagcaagggaggagaatctgcttcagaggcagctcagatagtgaagccaggtcaacagggaccgggtgatattcaggctattggaggccaagactggaaaaccaggttaagaatggttaaaacttcctccactgaattttctctttaggatcatggtcttaggatcaaggaaattttccagcatctttgaaactagaaatagcaatgcagtttcaaaagcagatgggtagctacagatgttggtacatacctgtaatcccaggattttggaggctaacatctggagttcatggccagctctatgagacctggtctcaatacaaaacaaacatggttatgcatacctttaatcccagcgcttaagaggtggaggcagacagatctctgtgagttcaaggccagccagagttacgtagtgaaaccttgtctcacaacaggtgaatgaacaagggcaatagcaaacaagaataacaaaaccaggtggttggaaggcgaacttgagggagagcaaaccaatgagagaggaggctttaaaagcacacaggaagaggaaaaaaacaggggtaatcgccacacaccctttaaaattcttatttatttatctgatgtgcactggtgttttccatgaatggttatctatgtgagggtgtccgatcctctgaaactggagttgcagacagttgtgaacagccatgtggttgctgggacttgaaccttggtggggttctctggaagagctgccggtgctcctaaccacttaggcatctctccagtccatgtgccacacatcattgtaagcagaaaggcagagatgaacacacacacaaacacacatgtacacctacacacatacacacatacatgtgcacatgtactcaaaactccaagacagagcacaagttaatcttgtcattcagttgagtggccagtcttgctcaaggtgcgaagatggtgagtgtccctagcatcttgtgttttatcagtgaatggggacaggaggtgtctgttgctgtccttctggtctaatcagtggaagtggagagaagaggattgaaatcctaggctggaagagaagcagataagaagcagtggccattctgtgttccctctctgttcaactcccttcttctccctcttgggttctttgtgactggatctctgtgtcgtatcctggcttggaacatgagctccttctgcatgcatctcccaagtacggggattgcggctgtgcacctcttacttgcttctctcccctctctgctcggggctaatccttggcctgctttccagccccagtggatgaagttgtgatttccatcctgtcgagtaacgaggtacagtctggaagtgaaatggtacttcggtgctctgtgaaagaggggacgagcccaatcacgtttcagttttacaaagaaaaggaggacagacccttccaccaagcggtcgtgaatgacacccaagcgttttggcacaacaaacaagctagcaagaagcaggaaggacagtactactgtacagcctccaacagagccagcagtatgaggaccagtccccgaagcagcactcttgcagtcagaggtgagtccacacccccaccagagcatcagtgtggggggcttccgagggtcagaaagcacgaattccttgtaaaagggagaggagtggagactagctcatttgggagagctaagagaccggtgtctgattagttacaattagcagaaacccactcatagtagcttgagcagaaaaagagatgattctatttatatataatctgaaaatgttttatccagtcccaattctaagtatccgatagagagataccagttgacagttgacgcatactgtgggttaaatgtctatccatgaacgacctgtatccaacatagatgtgttgataggattctagctgtgtgcttgaatgagagagtcctgtagagatggagggccaccccaaatggaacaacacctctacaaaattagcttggtacctccttgaagactgtagttgaccttggtttctagcagaagccaccatttccacccaggctgagtacagaagccctcatgggcagacaccaaagcaaaatgccatttttaaggatcgcaaaatggggtctgagttgctgcttaaatctgctgccatttcttgctggtgggaggaaaacatgtgtttcctttctttctacccgacttccagtcttccttgccccatggaagaaagggctcattgcggtggttgtcattggagtggtcatcgccaccttaatagttgcagccaaatgctacttcctgaggaaagccaagggtgagtgcctgtctgcagcctgggtttccagggaactgcatcctggaggaggctaagggagcaccatgcattctccttatgggatgtcggcttggtaacgcaagggcctggcgttggtgggtgtgaagctttggcggctcactagcaacggtgcttgtggagttgggcaagccaactggggggatgtgggtgacattatacctgatctagtcacaagaagctatttcttagtgtgtgtccccaagtgtggtggtatagggcacatacaggcatgcacattctgtgtgtggcacatgcacaaatgcacacactgtgtgcctcccagatattcttctagtgtgtcatgatcttgtatcatgtaccatacacacttgtgggaatagggtctagcctaggcttaagtaaaatggtgctgctgtctgagccgggaggagcagatgggttggggtcttttgtcttttccaaggtaggaaaaattgtgctgagctacacccccagtttctcttttctcctttattgagtatccgggctttaggagaatcaatggaaagatggtcactgtcctgtatacttacactgacctaagtttttctttcttttttaaagccaaacagaaacccgtggagatgtccaggtcggtgtccctgttaagaggggggtggcttctttgtgggcagggctggatttgtctgcaagcccagactggttgctaggaagttatcagagattcttagcaaactaataaagaataagggccttgggtataatgggtgtgtgtgtttctgtctgtctgtctcagtggaagattgccaactcattacatacttagaataatagagttgacctttttaaaagaaatgttttttaccaagctggagagatggctcaatctctgctggtaccatgcactataaatgtgcatgcgtgcgcacacacgcacacacctctaaaattaaaaaaaaaaaaaagtctttgcatccttttgccaaggctagccttaaattcatgatcctcttgcctttacctcccaagggctggattacccaagggcatgtggtaccacgactagctttttgtgtcttgctgtgtagccctggctagtctcagagtcacagccattctcctgcctcaacctccccagagctgtgattacaagtgtacaattgtcatatttcttcttgctttctcgtggtctttctttgatggttttgttggtttgggggaagaatatcaatacataattttctcttttcttcttcatttacatgtgaaggccagctgctccacttctgaactccaacagcgagaagatttctgagcctagtgtggaagccaacagccattacggtaaatccaagtcttcctttaattacaagtttttcccaactcaatgtataaggtaggattggagtagaagggaaaccccagcttcaggcagtggtaccgttaccgtatataacaaaccatgagaagattagtgatacacagcaaacagaaaggaaaggcaggaccttttctgctttccccatctctgcttcatttctttgggatgaaaaatggagactgaccctactgcttgttgcctccatagactgaaataattaggcagtacatgggagacagaaaccagattttttttttttttttttttttgagacagtgtttttctgtgtagccctggctgtcctggaactcactcggtagaccaggctgacctcgaactcacagagatccgcctgcctctgcctcccaagtgctgggattaaaggcgtgtgccaccactgcctggcttgagaagtcactctggtgcaggcctcagaggagagaggctgcccagtgagtctcaggacccttgggtctgtgagaaagtcactcagaggcaggtgtggtggctcactctgaacatctcagcactctgtagggaggaaggagcagatgcagatggacatattggagtccatcttggtctacatagtgagttccaagcccagttggggctccatatcaaaaccttgtctcaaaacaagcaataaaaacaaacaagtaatttgaataatagcactgattagcacaaacacactttggaaaaccatgtgttcctgaagaatagtataataccttatatatataagaatatcctaaggaaaacaacatgctaagatgtttgtttgtttgtttgctttatagtgcttgggattgagccaaagccttcacacattctgggcaagggcattaccaccaagcaagcctcacacttcattttgtgtatgtgcactggtgtgataatccagagacactgttatttctttaagtcgtattctcatcaacttacttccctaaccagacaatgttagctaaccatcagctttcatatttatttttagtcactggccctttctagaaaggagcttcatttttaattagttcttacatcaaaccattctgaattccaaataactctcaaacgaaagtgcccctctgcagccatactttctatccaggcagtggagggagggcccactgcgtgcaggaaaagctcacaccgcagagacaaaggaggagacccagggccagaggcgaaggtgcttgtcacctggagaggtcagacttggctttcttagcagtactggaggttttagaagttacagcgggggctggggagatggtgaagtgtttgctgttgctgtgtggatgtgaggccttggatttggttccctagcacctatatataagccacatgtgacagcaagcacctgtaaccccagtacaggggaggtggatggaagtgaccacaccccatgggctccatcatgagctagtcctgctgaatcagcaagctccaggttcacagagacgctgcctcaaaaaataaggcggagggagagtgatagagcttcctctatcatgtgatgtcacacgagcacacgcacacttgtgcacacacacatatgcatgggggagagcacacactcacacacatgcactcacactcacatcaatgggtgagggcacacacacatacatgagtgagaacgaacacacacacacacacacacacacacacacacacggttacggttacaggaaactgatatctattgtcactcatcctgactgttaatttttcaaccaggttatgatgatgtttctggaaatgatgcagtaaaacccataaatcaaaataaaggtaattatttaaaaattgtagtagaaacttttacattaaaaaaaaaaatcacgggcagctgtgtgctgtgtgctttaatcccagcactccgaggagagaggcaggcgggtctctggaatcaaagccagcctggtggacatagagagttctagagctacacagtaattagtaagactctgtctttaaaaataaacaaataaataaataatcacagagaaaaggaaacgtaaactctgagctgtctggataatttccacccgtcttagaggctctgtctatatgagcctaatggtaaagtgtaggtggccaggtttttttctccaaagatgttagccagtgttctgaatggtgatgcctcctaacctaagtagaagcaagctgtcatacctaaaaacaacaacaacaacaaaaaaacaaaacaaaaaacaaagaaagaaacaaaaaacctttctggctctccaagtgctgtaggagggtgtttctcttgggtggctgaggtggagagtttaaagaaattttttaaagacaactaacaatagacagtttacttctgcctaaggcttgttggcttaaatcgcctcaagatattttctattctgtgccgctctcttgagaactgaaactcccaacctgctccgtgaagtctctttggctacaccaactgttttagctgccagcagaacaaaacaaaacaacaaccaaaaaaaaaaacctctaattctgtgggtcttaaaacagcgcaggttttacgtagtcacatctgtaatcacagcactcaggaggctgaggcaggaagacaaggtattcaaggctagccttgactgtgtagcaagtccgggctgccctggaattcatgtggccctgtctgaagaaacagtaataagggctggagagatagctcgctgttaaacactggctgctctgtcagagaacccagcttccgttccagtacagtgaatggctcacaatcacctgtaaggctagtccctgaggatctgacaccctctcctggtctcctggggtactagacacaacgaacagcagcagcaatagccagagttgaaagcaaaaataatttcctgggtgcctccccagagcctggagattttgttacccagaatgcctcattttctttaaacacttagagactggtaagcttggtcctacagcattcaaatccatttccatggccttgagactggacaggccttgactgctggagcccatcttgggctgctgtccacacctattgaaaatcctcccacactctacaagtcagagaggctatgtacagtgtctgctgcccgaaccaatgtagggctgaccggaataaaggtttctagtgtggtttgatgcctccagaggaggtgctatctaaactcacagcgctgtgattcttttaacagacccccagaacatggatgtagaatacacagaagtggaagtgtcctcccttgagcctcaccaaggtaagcagccctcgccaagtgagccgagcccacattaggctctgggcttagatgtagataccacatgagatgctgtgtacagtcagaattgtctcttggaatggacatggtcttctgtagacctactaggtgtgcctaagtctggagctataaaactgtgattgtactctgcttactcactgcaggccaggcagggactaagagctgagcactcttctctggaagagtctatgggagacagtttcctatcccccgccaagtgttcaggctttctttcagaggccagcccctgctcagatgcactgtgctcctagaaaagttgtctgtgtggaccaaacgtgtgtcaatcaaatgcatgcataaaatggagaatatggggctggagagatggctccatggctaagagcacagactgtttgttctcccagagaaactgagtttggttcccagcatctgtatcgggtggctcacgaccacctgtaactccagctccaggggaatccagcgtcctcttctggtatctgcagacatggcactcacatttgcacagagcccctaccaccgctaccacacacaacagatggtgatgatggtggtagtggtggtagtggtggtagtggtggtgatggtgatgatgagggtgtggacgatgtatatgttactttgttgctgtgactaaatgcctgacaagaccaatttaagggaggagaggtttgtttgctttgctattggaagcaatacagttcttcacagcacagaaagtatgataactcagacaggtttttagatactgtgtccagggaaagcaatgaattctgggtctcagctacatctgtcctctttatgcaacttgggaccacagcccatgacaagtgtcaaccacatttaggatggctcttttcacctccattagcccaatttagaccatacagagagagggggggggggcaccacgcgtgcaattctaaatccagtcaaattggagattacccatcacagaggcctttcctccttagggggacgtttggggaaatagagtcctttccgtgtgacatgagatctgtgccttagcttttttgttaggtgtgtgtggttcactcaagggcaagctgcccataagtccatatctgattcagtgctgggagacagacgcacagtaggtgggttacagcagatctcagccgttctgagcaccagaaacaatacccatctcccaacccttctccatcttggcccacccttgggctgctgtgtgcttcaaaggaagcagccatcccaagccttccggcccttgggaagctccctaggactgctgccatctgtctgcctttgcgttgtgctgggttctcagccaagcaaccctgggcagttttccaggctgggcctgccaatcattagctggagccacttggtgatggtgtcctgaagccacctcttgctcgatgatttaggaccagttctggagtttctcttccatctcttacttaccgagcgtggttccaagtgccctgtcagcagttatagatgtgaaactttccaatcagtagacatgtcctgtgcaacaccactgacacatccctgtgatctccggtcagagctgcctccagaggtgtggactggagactttaatgtgctttgctgtatgggcatgggtggtgtcctgactggacctgaggggtggggcacgtggaaggcctgatgctcttgtctttttttttttttttattttggagtgaagtgtttgactcattttggtagctgatagtgacagtgacataaagatgccagccactgtgtgagacacaaaggcaagggtgttccctccctggtgtgcgtgtagtctaagtgggagctgggaaaactaaagaatagatggtatcaggtgattttaagtgctgtggatgggtagagtgggctgcagtaaggggatgctttctctcaccttcgctgagccatgcaagagggcctccttgagagccgttaattaagcaggggctgaaggttgtaagcaaggcagctgcaaggaagacagttgattaagggtggggctggttagaaagacacagggaatggaaagggtagttttggcaggtcacagctagctagctcatttagtttggtctgaaagggttgctgggtgtgtgatgcgtacccacactcaatcccaaagcatggctgtgtgacacaggaggaccaagagttcaaggccatcctgagatacatgagaccctgtctcaaaagtatcagaaaggaggctcatgtgtctgcagagacagaaaggatggagttaggaggacagggtgatgctggagcacatggggccccaaggatttcagtcctattctaaacggataagggaacataagggaacatttctggaggcttcaggctgggcaatggctggttctgagctccttctttaaaaaaaaattcttagggactcgggaggagttcagtggatagatagggaggccttatcttgtcagtgtaaggactggagtgtgggtctcaagaacccacataaatactgagtgagtgtgatggccctcctgtaattccagtattcctcaaaaaacagacaggggcttcccagggcaagctggctagctagaccagccatgtccacattcagcctccatgaatatggtgaagaactgttgtttgtattgatactagatttttttttccatacactatattcagttttgttttgttttggagacagggtttctctgtatagccctggctgtcctggaattcactctgtagaccaggctggcctggaactcagaaatctgcctgcctctgcctcccgagtactgggattaaaggtgtgtgccaccaccacccggccattctctctctctctctctctctctctctctctctctctctctctcttactctctctctcattagaaaaaaaacaggcatccgtaaaaaatgaggtaaaacacaatacaataatgaacaaaccagaatagaggaaatcaaagaaaagccaaggaatacacacacacacagacacacaaccacacacacatacacgcaatcacacacacatgcatacatgcacacacagaagtcccatagagtcacaaatctggggaactattgagaaagattcccagtctttctcagacctccatacatgttagtcctcccaagacatacaaccactgcacacataccatacatacatacatacatacatacatacatacatacatatatacatacaaaagcaaactcaggaccatcaaggaagtggcctgaagaagaacaagacagatgtgctatcactgtacaagagatagtgggtgccagaaatggatggtgtctaggtgcacatctgagatccatcacagctcgtggccaggattggggagccagagtccctatatttcttgctggagtagctgcatggacggctgtggtgtttgaggataagatccggtttggctgggttaagtctaagatgccggtgagacaccctagagtaggaagctcaggggtctggagctcagaggcaagccaggacagatgaaactgtagagtgatcagtatcagctgtcactggtccagcctgggcttcgactgcatcctgggcttgccaacccaggtaacatctttcttcttcctagaggtaagggaaggtgctagcttaagggttgaatggcaagatcagagccggctacaccatcctttctgttctggactgctgcattctaccgtggtgggggaacactgacagctccaggcacaggggaccaaatccctgctctcttgtctgtacagaacatcctcaagttgcctgtcaccccaggctcggataccaggctgaatccatcctcccacagtggtccaggcccaggtctgggcaggcagcagcctgagggttgtgcatgatacttgtgtgggagcgcgtgcctgtgcgctgggagttccgaaagctgaagagggaagaaggaagcatcactggccctgggaaaggctccatttcccttttgttgggagagtgtccttgtatctggtgttcttttgctttcttgagagtgtggaaggattgaatagaggaagtgtggcagttcctagaatagggtgggaccgtggcaattgcctctggcttccctcgatagattctgcagccgtcccttgcagccaagctatcagtcacatttcccagcttgcactagttgcccagtcagggctctggggaagattctagaacaaaggtcgtttgggtggcaaggggaacttaagaggatacaaattgtgtttcctccttgttgaagaaggacagtgaggaactcaggtctggaccactggtgctggccccttgttctcccccaagcagggacaagggcattgattgctaggtgaagaaagaagggctttgtgggttcaaggtcaatgatgactaaatatgagctagtgcctgccagcctggtcccctgttctcaaggtctctcatcctacacaattggaggaggctatggggaccgggtccagatctaaccctggctggcagctcaccaagtggtcactgcggatggaggaggacgggaaggaactcattaaatcccgatttgctgtctgtttgctccgaggctaattgctgggaaaaccccatgacgttggagccgtctctttctctgttagcacagagaaaaacagaaaccaaaatagagacccatcaggaaacgcctctgacaagcagagacaaacagctcctggcctgggctagtctttagcaggcagctgctgccaaggagacatgagagggggaagggcagtgagcagctgcaccctgctcctcccctacccccgcccccaccccctcttactgagctgggcaaaaccaggggcaagcatagaccatgcagctcagtctagaagtggaaagcatcccttcctgacttgaggtaggcacagcctgaagccgctgaggtccagagaatatcaaactgttgccaaggagaccagagaggtacctggaacagtggagttcacaagatgtccaggctaaccccacccatgtttggctgcccagcccacccagccctcacctcaccctcatcccaattcatgtcccttctatcctagctccttgttaggctagggcagaggaaggtctagacttgcttcttatggacgacatcttatagcagttatcacgcagttatttttagctgtgtgtgtgtgtgtgtgtgtgtgtgtgtgtgtgtgtgtgtgtgtgtgtgtgttgtgtgttaggatacacctgtctctgagtacatgcagaagtcatggactctaatttatgtcaggtgtctaatttatgctcagtctcccactaccttattcttttgagacagtctcctgctgatcctggatctaggctggcagccagccaaccctagcagtcagccctcttacctctgcccctaacaattgctggggttataggtgcctacagctatgccccagattgtctgggatttgggttcaggattccagctcaggttcttacgtttgtgcagcaagtgctcttacccactgagccatctcccagccctgtggtatttgtttgtttatttgtttgcttgcactggggcttgaacccagagccttgcacatgctgagctggtactgtatcactgaaccacatcttcagctcattaacattcttggcacatctgtcttccctgaagcctagagcacctgaaagctagaaccggatctacattttcttctttagtggttgaggtcacataggagatgtgtacagtcgttaaatggatctcttggtgtgtagaaggcgtcttggagacgcctggagtttcagtctctgcttgcatgggatcctgttgtttctcaatagttctcttaggcagatgtctttacactggggaactgggatctcagctactttactgacctccaactcctgccttgggaagtgactttaattccttctgcaacgccttcatcattctgggtgccccaagttctgctgtgatgatgtggaccactcctggcctttctctgtcatacaggatttatacagccacccacatccagtgtctaatgagaaacctagactttagtcccacagcctacctaccagtcctgtggcgtgctccttattacatagacaggaaatctcaggaaggggctaactgtgcctcgaccttctgaagttcaaggtcggcaatgcttcagggcctgggctgatgcttttccttcattaccttgcagacaatgctagggatagccaagactgactggaagactatgcaaagcctgactggtggggtggggtggagcctaagctgggcctttgctctataagaccttgggaatccaccagggcagacaactgtgggaacaaagaaagcaagcatgctttgggtaaatgtcaccaaactgctctggggtcacaagagcccatggaacagctcagggcacagaagatgcaaatattgggggtatatatgcatatggctgttggggtgatgctgcaagagaaggaaccgcgtcagaaatggaagggctcagaggccagagaaaggaagaggtcactgtaggagtggcctcacagcaaagtgagaaagtatctttggtgtagttagaatccatgtggggccccaggcatctgcaataaggacagcatgtggcaggacatctcaggctctctgagggagataggcagaggagggggctagcccaaacccatccagctgtgcaaggagacttcctggtcttccctgcaagtatcagaaacctaggatgtgttctggttttgtcctgcttcctcggtgtctctagatatacgtaagtctgtatatacatgagtgcattctctgtgtgagtctggatactgtgtacaagtatgtatagtgtgtgcatactctgtgagtgtacacaacacctgtatatacacatccttgaacatatttcaatatgaaataaacaggtagccttgtcttctattctgaaggtctaagccagagaattatgacactggctataggttcaagaccatgcagagtacacccgtgtacctaggcgtaatggtgcaggtctataatcccaggacttgggagatgaaggctggaggatcaggagttcaagaccagcctaggctatccagcaaattcaaggccagtctgggctacatgaaactgttttaagcaacaataacaatacaaacaaaaaaaccccaacacagaacaaactcatgccaggccaggccccagcgtgcttcacttagattctgtagtgagcctagatgttgacaccagaggcaggcagctcagcaagctctatctgtaagtggctgttgtcctgtctgtatggctgctgctcatgccagactccaacccagacctcaggatccaattctaattcttgggatccacccccccccccaactcccagtggctgtgaggctgtacatagcagagccctgataggcaggtcctggtagggcagctgacacagggtctccgtggcagggaaaggggggtgggtgactgggctagggactttgggtctgtgcagagtcttcgtgcagccgggctcttcacacagtggcctactgacctactttcagtgtctaggagcctctggttaggtctgaacttctgaagctggggaatgatgatatactcggtgtggggcttctcgacggggcagcgttgggtgtcgggaaggtacagcagtgggctagcctggggctccaaggcagctactgacctgtgcctggttccctttccagctctgggaacgagagccacagagacggtgtacagtgagatccggaaggtcgaccctagtgagtgaggggcccctgattcccagagtgggagggtctgtgctagaatcagtaatggggccttgagagtgggcagaggggtgggggaaagccaaaaagagcatcaactctttatcaccgtcccccaaaaccctcttttggtttttttgagacagagtttctctgtgtaggcctggctgtcccagaactcactctgtggaccagtctggcctcaaactcagaaatccacctggttctgcctcccaagtgctgggattaaaggtgtgggacatcacttcccagcagagcatcaactcttatattagggtctgactctgtccctcctaccaccctaagaatacagaggcacagacagtctaagatcaagatcacagaagcacatctctgagcacccagagctagactccacattcccatcactgagctgcagtctttggttagagggaaggagctggcaggacgatttttcctcttactggcctgggttcctgcctgaggccttgcaaatgagacagtccagcaaggaataagtagactgggttgattaacctgtagaagaaatctcagagaggagtgactcagaaagaaggttgggggaggggaggtatgtaactgcttaacaataaacgtgtacagaaaggacaggatgctgagcctggtggtacaggcctgtaatctaagcacagggcagggacaactggaaaagcaagcgttggtcgcccttgcctgtatataaagttcaagaatagcctggctatgtacttgagaactgtatttaaaagatggggagggggccgggcgtggtggcacacgcctttaatcccagcacttgggaggcagaggcaggtgaatttctgagttcgaggtcagcctggtctacagagtgagttccaggacagccaggactacacaaagaaaccctgtctcaggggaaaaaaaaaaaagatggggagggagggagagagaaagagaagaaagaacgaggggctggatagagactgctcagcggttaagaacacagcggttaagatgctcttgcagagaggatgggattcagttgctagctcctacatggtagcttgcagccatttttaacttcagttccaggggatctgacaccctctctggcctccagaggcactagaaatgcatatagtacacatatatacatgcagacaaagcatccatattatctggggcagactgtccttacactcctcatggtcttcactgctcatctgtcttgatttgggttcctgtcatcaccagatccattggagaatccaattctacgttaaaccggcatctttgtgtgatggggtggccctgggtggccttggtcaaaccatgaaacattcccagacttctttaactgtcaccttctctgtgaaatgaggggatggactagattcctggttagattgcccgatccactcccagccctgagtgtctgaatcctttaggttgaagaatttatatttctaaccactcatacaatattggctgaggaagctggcctggggactccagtttgagggtcagtctgtgagtgctgtgattgtgccacacaggtcctgcccctagggtctctctcactcccccccccccccccccccgcgcgcgcatcctgtactgatcagaacagagacagctgagagagaaaatccagaaataccctgtgtgtgcacagagggtggcagaaggtgcgcgtttgcagctggcggctgactgggtgtagggaaggctcttagcagccgctcccctcacagtctgctatatcttcagtggcaccccaggacaggctgtttggggaaatggctcatagggcggagttttggctctgaaaccccctttcccctgagagattcaaaggaaggccactcccctagataagcagaagggcttaggcaggacagcctccaaggagcaggttcccctnnnnnnnnnnnnnnnnnnnntttgggggagcttgacaaagaagcaggagggagcttgcaagccatgagaggggcatgctgtctgcaatctcggctttagatgctaagctgaccttctttttctgtattgttataacatgtacataaaacttaatgttttaaccatttccgaatagtcaggtggcaaatgtggtgtcctttacatcctttgatactgttgggtagccagagttctcaccacccatttcccgaatctccatcttcccagtcccttaaccaataactccatccccacctgctgcctgccccagccgttggtcctcaccattctgtgaatttggccccaccacaccctgtctgtgaatttagccacgctcagccttttctcatgtcaaacgaagagactgagccagcgggtttgagctctcttttaattgaaacacttcaagagtcccagggttgcactggcaagaaggtcagcaagcaggtcaaggcattatcaccaagcctgacagcctgagttcaaaccctgtgactcacatagtggaaggaggggctgaaccccgaaagttgccctctgacctccagatgagcatggcagcacatgcacctcaccacccagattaagtaaataactggaataaaaataaataaatgtgcacctggcagtggtggcatatacctgtgataccagtgttcctgaggcagaggcacacagaactctgggtttgagaccagcctggaatatagacagccatagctacacagagaaatccagccttgaaaaaaacaaaacaaaaagagataaaaatgtttaaaagattaaataagacaggcatggtagagctcacctctaattccagtacacaggaggtggatctttgtgggttcaagtctagctgggtctataaaaacatttcagaccagtcagagcaactaagccaaaccagttaattaattattaattaattaataatcgtttcaggttcctggcatttggaaatagagagcagcccctcagccttggcccctctagctctgtctgcctggacacacctggggtgtagtcactttaagggttaacccgagtctaatcctcaactcaccctcatctctctgtcgacactcagattctatagatgttttcagaacttcctagatctcagggtctgcctgtcttcatttctccggagttcgcactggccaggatccagcctggacatttttctgtgccattgtcatggaaagctccatagctgggccccctgatgttggctctggtctcgtccgacagatggacagagtgaccctggcacaggaacgactataaaagtaggcagaaatacactacagtgaatcttgggagggtaagggctgtgatgggttttgtaactcaaacattcagagcccccctcagggtctgctaagtctctctgcagcccactaacaccagcttgccctagcaatgggctcttaggtaagaacctcttaggcagaggcaggcggatccctgagttcaaggctaggctggtttacagagggagttccagggcaaccagggctacccggagaaaccctgtctcggagaaatacaaacaaccacaaataacaaaacaaaaagaacacctctagacctttgaacgttgtcctttcctgttgctgcgtgaggcgctaatgccagcctgtcccctggctgagtgtgagcggtgaggggagggcaggcattctcagaactaacaaagtagagataaacaaactctatgcctgtgatgctagcgcttttgcgctttcgaggaggaaactatgctttccaagatggggagttcaaggccatcctcgggtaaatagaaagtccaactccaacccaggcctcttgagaccctattcaaatgagagagagaatgagagagagagagcaagagaggagccaaatctagagaggccaaagggaaggaaagaatatgcgttggttgtaatcagaacaagtaagaggccgttcttcagcagtaatctgtgggttttgttttttatgttattggtttaatcttcagtttccgtggaggaatgaggccaatgctgttgatggtcaccaccacccaccccatgattgactgattgattgattgatattggggatggaagccagtcctcctgagtatctgcccttgagccacatttctgggtctttccttgtcgcttagatgcaaacttaatctttcagcattctaaaagttattttcccttttagttaaaaaatattagccgggctatggtgcatacccctttaatcccagcactcaggaggcagaggtagtcggatctctgtgagttcgaggacagagcgagttctaggactgccagggctgcacaaagaaacgctgacttagccgagcgtggtgttgcacgcctttaatcccagcacttgggaggcagaggcaggcggacttctaaattcgaggccagcctggtctacaaagtgagttctaggacagccagagctacacagagaaaccctgtctcaaaaaaaaaaaaaaaaaaaagaaaagaaaagaaaaaagaaaaagaaaaagaaaagaaactctgacttgaaaaagaaaaacaaaaaccttcatgtatgtaccgttggtgcctggtaccacaaaggctggaagacagagtcagatactctgggactggaattacgggtgtttagttgtgagtagccacaagggtgcggagactcgaacctgggtcctctgcagaagcagtcagtgtccttatccactgagccacctctctaagcctttacgtcttcttttatattactttcctgaggttagaattcacaagcctcagtcagtggctctagttccagtttatgaatgaatcaccttaaccagaagagggaaccgttaagtgtgtgtctctcagggcacagcggtgaactgtaagagagagtaggccaggccgaggctgtatacatttctgtctgtcacttaactctggactccattgacctcagacttcatgcgggataatctgtgatatgcctgagctctagggggtttcgtttcatggtggtggcctgcagtgctggagagtcggcccgcaggacctcaggcctgccagttagatgtctgtccactgagtcacacccccagctcagcacacatgcacggttgctacaacctggtgtagggagagcagtcctgatgagtctggtgagtaggagtcagggatgctatgaaacatctcgtggtacagtcagtctcggtcaagagttcccagcccagaatgtcagcaggatgaacacagagaagccctggcttagaggacaccagcttctatgcctgtccaccaggagagctccctcagacaccagctcttgctttctctgtgtccacctcaggagctgaccagggcacctggtcccacccacacctctggcctgtaaaggaaaccaagtcttgctctcagccccagctctgtgtcagttgggcacccccactccccacccaagcgtcagctactccacccctcttcacccttgctttctctttgtgtggaattcagacttccaggatcttttcctttcatcttcttttccagttcctccctaccccatctccttttctttccttttctttaagacagttcagttaacctccaattcataaccttcctgtggcagcctctcaaatggtgtcattacagttgtgcaccaccagacccagcccaggatgtgtgaatggggctgggggcggtgggaagcgagtgggcagaaatccctcatctttctcacattccttactgccccttaccaaaaggatagccatgacaggaagtaccatcaagaaagaacctgacctggacatcatggcacttgaaaggctgaggcaggaggattgctgcaaatctgaggctagactgggccaggattagaccctacatcaatttaaattaaggagaagaggcctctcagcaggaagccaccatgtctaagggtggaacactctctggtctctgagccctgggcttcatcttgccctccctccccctgtaccccctccccccattcctagaactctgagcaataaatttctgttgtttctacatttaaaaaggaaaaaataggagcaggggtgggggtgggggtggggtcctggctaagtcctctgaagggagagaagaacacttgaaagttggttcccacccatcctgtgtggcccaaagccagctgggccagcaggtactgccagggtggcacttcctgcctgaacacgcaggaggggaaagtaccttacgccgtgccccatcgtgtaacattacccaccaaagaaacagtctccaagtgggcccagacttgcctgccatcagtcttgccttctcccatgcagagttttgttttttggtttgtgaggtttgttttttttttttttatatttatttacttatttattatatgtaaatacactgtagctgtcttcagacattccagaagagggcatcagatttcgttacggatggttgtgagccaccatgtggttgctgggatttgaactcgggacctttggaagagcagtcggcgctcttaactgctgagccatctcaccagctcctgtgtggttttttgttgttgttgttgttgtttttgttttttgtttgtttgtttgtttttccgagacagggtttctctgtgtagccctggctgtcctggaactcactttgtagaccaggctggcctctaactcagaaatccacctgcctctgcctctgcctccccaatgctgagattaaaggtgttcatgcgccaccatgcctggctgccatgcagagttttaacacgtcacattttgtttctgcttctggagaacgtgggctgggtgggggaggccgggacatggggttcttctcccctgtggagacctgggccaggaggagctgtcatggcctccctcggtgtgtggaggctgacagagtggctgctcggtgcctgggctgatgtacagattttttgagaggccaactgcctttgtcccgctagaatagaagaggggcccctttgggacagcggttcctgttccctctaactaggaacaatggaatattatatgacagggtttgaaggggaagtagacttggggaaagcaggtttttatttgtttgttgttttgtgacagagcctggaactcttggtaatccccctgcctggcagcttgactgctggatttacaaagagagctaccacacaaggctcaaagggttttttgtttgtttgtttcttaggattttttggttttgccttctatctttccacctcttcttcctctgtgtctctgcctgtctgtctgtctgtctctctctctctgaggatgaccttgaactcctgatcctcctgcctccacctccctaacaccagactttataagccccgtgctgccacaccaatttctatgatactgggggtcagccccagggctccatgtgttccaggcaagcacttaaccagctggcctgcacccttgttcttggctttctcgccatgacctttaccatctgtaagagcagccaccaaccccctaaccccctaccctgtccccacccctaccctgcccccagcacatgggaacttttttcccagagagcacatgaggtattcattgctgctgtttccaccagacctggagaatcagccccaacacagagtcagtccctgggatgggcgggagagtctgactctgtgcgaagaggcaaatcctaccccagcctcccatctggtggtgaggctcctcttccagtgatgcaggcagtgatgtgatccttccgtgcagagcttcctgctctctcactctctccacttccaggcttttgtcagaggccatgggcataacaacggtggcctggctgggcagccgggcacagtgtgcattctgacaaaaggatgcgtcaacttgagcctcatatgggaaagggaaattgcaggctctgctcttagtcagtttggccatggatgccaagagcctgagttatcctcctcctcctcttcttcttcctcttcctcctcttcttcctcttctttctcctcctccacttcttctttctcctcctcctcttcctcctccacctcttctttctcatcctcctcttcctcctcctcttcctcttcctcctcttcctactcttcttcctcctcttcttctttctcctcttcctcttccacctcctccccttccatccttactcccaggaatgggcagacagtgtaaaatcaactgtgagaatagatttgctgccaaagatattggcaacattatttacttaagacagcaaaatcctggacagaacctcttttgtttttaagttttgtttatgtgtatgggggttctgactgtgtgcgagtctgtgtagcatgtgtgtgcctggtgcctgaggaagccagcagaaggtgtcagatgccctaagactaaaattatagacagttgtgaaccaccatgtaggtactggaaatcgaatctgggacctctggaagggtagccagtgtccttaaccactaagcgatctctccagccccagaacctagctttttaaagttaggaacctggttaagcaatcagctgtgtagccacttaacttgacggtgtagctacttggacagtggcatttaagaaaggtcatgagccaggtgtggtagcgcacgcctttaatcccagcacttgggaggcagaggcaggtggatttctgagttcgaggccagcatggtctacagagtgagttccaggacagccagggctacacagagaaaccctgtctcgaaaaaccaaacgtaaaaaaaaaaaaaaaaaaaaaaaaaaaaaaaannnnnnnnnnnnnnnnnnnnaaaaaaaaaaaaaaaaaaaagaaaagataacaaaaggaaagaaaaagaaaggttatgaaagttcttacaaaaccacactgcatgaaaggatggggtggaacacatcacaggcctatcgccctaacttcccctgaccctccccaacagtccactcagaacactgctaggggacagtggaagggaccaaaagtgggtggagggtggagcagagatcacttttatttgcaactttctaattttctgttttctatttttctctactaattaaaaatctttaaaatgccacacaagaagctgcacttcttcgatcccggcactctggaagcagaggcaggtggatttctgggagtttgaggataccttggatagttttgaacagatagctcaaggacacccagggctacataaagagctcctgtctttaagaaaagaaaagccacagtgggggtgtagttggtagaatgcttgcctagcatgcactgggccctggacttcattcttagcaccccatgaactgtgtggtggttcatgcctataattgggaaatggaagtctcagaaactcaaggttatcctggactacatagtaagttaaagggctagcctggcctacatgaagccctacttaaaaaaaaaacaaaacaaaaaacaaaaatcaaagctagcacacaaaaaggtcaaatgacgttccagggactctacatgcctatctcatggctgagaagatcccaggggcttgcctagagacaaaaggccatcagtagatggcctgagacccccttatacactagtgttctgtcccgtccccaaccctcctctatatcccccctttgccatttgccactttgcacatttccagcagcagatccagtgtgaagctgccctacctcgcacgctcacctttgtgccgtctttgttttgcagatctcatggaaaacagatactctgtaagtacacacgtcacacacactacgttaaaaatgcacccatgaagcttggtagtagctcatacctgaatcaccacactgaggagtgttgtggacgtttgaggccttccttggctacagaattccctttcaggactgcagtatgtggctgttgctgttgctttacaaaggtgttctatagaacaacgaactatttcccaatttgtccagggtctgctttctactaattctcgccagcaccttgttctaacctggcccatttgagaccaggaaccgtggcatcctctggcagtctaagccagttccagtactgattctcctgtctataccgttacagctcagtctatatagggagagggaccatgggaatcctcccatgtcgctgggagtctttctgctcttttagtaagaaagagtctcgggcatagtgagcgacacacacttgagagaggagcttgtgtgcaagaccagtttggactgcatactaagtccctggtgagagagggaaggggagaggaaaaggaaggaggaaggggaagagaagagagatgaagagaggaagggtagggagatagggcagttggccacatacttacacaaggatctgggtttaatcctagaacccaaagtgaaaatttcagttgtagtggcaaacatgtgagatcccagtcctggggagatgaggacaggtccctggggcttgccaacctgcatggtgagcctaaggccaacgagagaccctgttgaaagaagggaaggaggaaaggaaaggaaaggaaaggaaaggaaaggaaaggaaaggaaaggaaaggaaaggaaaggaaaggaaaggaaaggaaaggaaaagaaaaagatgaatggttcttaaggaatgacgtctgagattgccatctggcctctatatgcacgtagacacactcacaaaggaacatttgtacacaggcatgtgcacgcacgcacgcacgcgcgcgcgcgcacacacacacacactcacacacacaaaaggatgtacaataaactcaggagggagggagggagggagggaaggggtttaagttcaacccattcataacccactgccttccggttcccagcctgtctgtgggcacccagcagcacaggggttaacagggcagctattatcttcaaaaataaggaactggcctctgaactggtcttttgggtctgggagaaacttccagcaagacttctctgtagccttcagtggggccctggcttcctttgttttgctgggtctgaattcttgctaaacagagctcattatgctctggacagacaggaaggcgctgacattctctgtggggatgaaggctgtctgtttaaggcgaagaggaatgaggtgaacagcttccctagctgcacccacccaggctgctgagagcactgttgtgtggaaggggcaagggagcctgtttcatagatgaagaaatggggggcctgccttgctaaagcatccagaatccctgagaagcagaaacagaggtcacgtctccaaaagccctggcctgggctttgtcctcactgttaagaagtgacacaagccaggcttggtggtgcttagctgcagtaagtgatctctgtgagttcaaggccagtctggtctacaatcctttagccctgagttccaggacagtcagggctctgttacacagagaaaccttgtctcaaaaggaaaaaaaaaaaaagtgactgtctcccaagaggtgagaataatgacaagcttgctccacaggcagagtaggaccctgattaagaaaaaaaaaaaaaaaagttcactggctgttcccatggccgtgtgtatctgtggccacccaaggcagggctgcgggccagccgtcggaactttgccgaaccaacctagttactttgtcttccacccaaaggggctctctggacaaaggctctgaactccaggccagtggcagaatggctttccctcagcccccaaagtctactctggtcgcagggtgctcccagtacttgggctagccctacctccaaaataataaaaccatctggcaggaactcagggcttcccagtcgttgagaagtgaattttgaatcttgaagcaaataacttttgtttatgaaagaagcatgcagcgcttccctaataaccagccagcgtgggtcagaagaaaatgaacactgaattgctcggcagggaaatgggaggggcttccttcctgaaatcaaacctggcaatcattcctcgcttgtttaatggcctgaggaaatatctggacaatgagacagccacttagccagctacgagcttggtattgtttgacttgctccaatggcacaggctgacttcactttttcctcttgccattttttgccttgtttataaaccgggtttgtggcccacgcagacagataacgtggaagagaacaccctgtgcttaaaagaaagagctcgaatctggacctatgcgaaggtctccagatggtgggcagaacccctgactcttaccggttgggaacaagacagtgtcagtgatggggtcccttccccactccccaggaccagcagggagatgagttgtcacaggacctgctcaggagtggggctgaggctgctgctgaagaacggggtcccacttctacaatcttcttgtgggtgacttcctcaaacctaagcaccactgcctgtaaagtagaaatggtgatggtagtggtgatgcggataatgatggcgatggtggtgatagtgatgataatgatagtgaaaatgacgaagtaacatctgcccactgggattttcttaagggttaaatgagactctgcagactcaagccatcacaaaaaagccactgtctcctttaatgatcttttcctcaagcactctggtaacagtggatacggttaagagatttactttattggctctgaaatgcaacacacacacacacacacacacacacacacacacacacacacacacacgaaactcaaagcctaggattcatcaaagccaaagcttgacataggcctgggagaaccatatacagaattatcctaactagctgcttagtctgtatgtaaggttccgtcttctcatcagttaccatttttataaaaagggtgtctgtgtgtgtgtgtgtgtgtgtgtgtgtgtgtgtgtgtgtgtgtgagagatgcagtcaggataatgtctgagagtccatctccctctcctgtgggcttcaaggttagaactcaggcacatcttcaggcttgtgcactcttgcctgcggagtcatctctcccagccccatttccacgatctgcaaactgggtgacttctcacctgcatttctgcagggattaagagaacactcagctcgttcctgatagactggaagtgctcaccctgagaactctttagaagtaggagtcagggacccgggcaaggaggtggagtcagaaaggtctttggggttactgggggacggaggggggagggggtatggggagnnnnnnnnnnnnnnnnnnnnnnnnnnnnnnnnnnnnnnnnnnnnnnnnnnnnnnnnnnnnnnnnnnnnnnnnnnnnnnnnctgagcagaagcagggcagatccagagctgacagctggcttctgactaaagcataacaagtccgctcctcactgagagtgtgttaactttcacgtttaagtccccagaccctgctgatggactagcccttcctgtctgtgagcttggtcccattatccagtgccgttttccctaagagagggagaacagaggcatctggggagagacttggtctggggcctgcagaaaggctagacacgaggatcccagctccttgccctggaagagcggaggaaacggcaggcagcagctgccagtgctggcaaacctccagcgctctgggctcacacggcttgcttggcccgtttgtgcagttccatcctggcaagggaggagccagagtcttggtctcctagttgggcctctcaggtctgcatcctgtgctaaaagccccaggcccagccaaacaaaatggagagtccaggaagccagccagcctggccacaggttccctacgacgccaggcaacctttacatcttcttttgcccccacctctgttaagttccacttacagcaaggtgtcctcggtccgcagagggttctgaaccgtgggcctgtgtttcctgttcttcagggctctccttttgcaaggctctcagctcccgaatctcccagcctgcccagctcctctgcttgcaaatttctttcccctttacaaaatcttagaagtcagttcaggtcacttctgagtacttcaggagtgtcctggtcagaatgtgatgcccccatgcctccaaattacttcatcgaaatgttgatctgggattgataaagggcagggaggtggctcagtgggtaatcacctgtgtggcaattgtgaggccgtgaattcaaccccacaatccacataaaagccaggcattggtaaccccagcattgagatgggacgtggggagccccttgaaactcttgggccaactagcaacagggaacaatatgagacgtcgtctcagctgagcagtggtggcgcaggcatttatcctagcgcttgggaggcagaggcaggtggatttctgggtttgaggccagcctggtctacagagtgagttccaggacagccagggctacacagagaaaccctgtcttgacaaacgagggagagagagagagagagaaagagagagagagagagagagagagagagagagagaccttatctcatccagaatgggaggtgaaagtacttgaggctctcctgatttccacatgaaccccatagcacagaactgaatatgcacacattgtacacacacacacacacacacacacaagcaaaatcattggtggactatgaaatccttgggacagagtctgtcctcttcgggatagagatctgtactaggtcagataaaggtccagaaaccaggaagtgggtggtgggtgactcagactaccatttggggctattttggtgctcttttgagacaggtcacatatgaagacagcccaggttcttctgaggattactttgaactcctttttttttttttaaagacttacttatttattatatgtaagtacactgtagctgtcctcagatactccagaagaaggcatcagatttcgttatggacggttgtgagccaccatgtggttgctgggatttgaactcaggaccttcggaagagcagtcggcgctcttaaccactgagccatctcgccagccctactttgaactcttgatggccccaagtgctgtgttctgaacatttatctccacgcctggctttttttttttaactttttttttattattacagtagaacatacacaacctaaaattaaccactacattattgtaaagtagtatcgttcaagagctggggtatggctcagagatggagcaatgcctccccagcacttaaaaacagagaattcagttgcacgagtcacattcataatgtaactgtcactacaatgcactctcgatttttttttccttaaattcttgttacatgttcgtttgcacacgcattcaacagtcagagacagcttctgggagctggttcttttccttcaacctctggatcttgggactgaactcaatttatcaggcttggcagtcagtgagcctttctactgagccatttaaccagccctccagaacttttttttttaaagatttatttatttattatatgtaagtacactgtagctgtcttcagacactccagaagagggcgtcagatctcattacggatggttgtgagccaccatgtggttgctgggatttgaactcgggacctttggaagagcagtcagtgctcttaatcactgagccatctcaccagccctgaacgttttttttataaaggatttgtatgcccacacgattgtgtgtggaggaccatgaggcaaagagggtgctagctgttgcttatgactacctttgaaacaggttctctcgctgagcctggggtacatatattctccactagactggaaaccagaaagccctaacactctgtgctcccctcagagctggaattccaggccatgtagaccaggctggccataaacgcacaaagatctccctctgccagctggatgctgggactaaaggtgtgcaccaccacacccagccacattttttaagttaaccaagtttttaagctgacctaaggacctaagatggcctggtgactcacgtctaccatcccagcactgagaaagctaagaccaaaggaccactgagctggcccaggctacagagtgagtttctggttcaaaacacaaaaccaaggcagactagagaaggtgtctgctagccacaggtccagagggagttaggtgtaagctctctcctacctgagggttccttccatttgatccctgtgcagcacccatgggacaccacactgggtgcacgtgggtatcgatgcagtggcctgatactacagcaagaaggtagaggtagtgacgacagcctctacagagcaatcatggagagaaaagaagataggggggggggggagcagaagctgccctagaagacggagtcccaaaggatggtggcacagctcagtgcttttgtatgtttgagtcgaggtccccaatatccaggatagcctagaactggactttgaagttgtgatcctcctgcctctacctcctgagtcccgggattacagacatgaatcatgtgtggtggtagtggtgatgcagcttagacctcaagcattacacccaagcacccacattctcagcccctttggcgttctcgtgtgctgtactggttcaatttatgcctctctcctccggggtgatctctagtcctcagggtgtaaccctaactcttgtcttctgtcttacagagaacggaaggctcccttaatggaacttaagacagtcaaggcagtgcacgtccctgggaggtcgtccatgtcccgagaagagcagccgattcctggattgcgagagtcctgtgcacgtatttatgagcctgtccccaccgaaagcagtaatccttcaggccaagccatccaattttaaaccccgctgccttgttcatgttgggtatacagagactcagaggcgctagttaatggccagcctgacctgtcttccttgtgtttcggggggtgaaaggaggttccaggagaataatgccctggaatattctgaggctgaaatgttgtgtctcggatagacagagtacttctccgtgggtcctcctgcacagaagcccccttctgctctgttgtcaatcactgggttagttttttgttttgttttgtttctgttgttctcttctttctgggttgatcttaatctttggaaatacacagtgctgctcaggtttgcctggttcccctgtgtgaccttcccccccacacacacacaaagtcaaccagctgactgggagcaatgctcgtggaatggccagtcacttgaagacagacctcaagccagcaatggcaactggagcgagcacttaaagcgcaccttgatcttcctttccgttccatgccgaaggcccaaagaagagaaatggctggctacaacaactgttattatttttttaatagtaaaaggaaatatgtacttttctcactaatttttctttatttattccccactaaagaaacggtttcctaaggtctgagctgtttcccagggtgggctagagtgggtgggcaggagctgccgacattttgtgtactatacctaaccctcctcgccttctccgtttgcctcagccacccggctccagggcccctgaggggagttgtattaaataaaattgatttttactcttcagttatctgcattcaagtgtcatctactggaacagggcacatggcaataaagtaaacgtaggcctagggactctcagtgtgtccagtgtcacagagaaccaagcagttctcttgtctccgagtggaatctcacagggaccaacagcctgggtagccagagcctttgcactgtgctggggtccacttcaggtcctaatgatggtgaggcaagcgcttcaccaacctccctattctccaaccccaaccccacccccattcccccacccccgttatgctttttaagtttttctgttttttgtgttttgggtttttttttttggtttggtttggtttggtttggtttggtttggtttttttggtttttcgaggaagggtttctctgtatagccctggctgtcctggaactcactttgtaggccaggctggcctcaaactcagaaatctgcctgcctctgcctcccaagtactgggattaaaggcgtgcaccaccatacccggctaagttttttgttttgctttggtttttttgttttttttttttaagatttatttatttattatatgtgagtacactctagctgacttcagatactccagaaaagggcattagatctcgctatggatggttgtgagccaccatatggttgctgggatttgaactcaggaccttcagaagagcagtcagtgctctaacccactgagccatctcaccagccccgctttgttttttattttacgtcatttttattttattttatttggagacagggtctcattgtgtgcacttcattaattagtccagcctgggctggactgacttcaaactcactatatagcccaagctagccccacactctttttttttttttttggttttttgaggcagggtttctctgtatagccctggctgttctggaactcactctgtagaccaggctggcctcgaactcagaaatctgcctgcctctgcctcccgagtgctgggattaaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctcactgtctcttctccacattaaatggccagcaatgggggctggagagatgatggctcagtggttaggaacactgactgctcttcctgagttcaattcccagcaaccacatgatggctcacaaccatctgtaatgggatccaatgccctcttttggtgtgtctgaagacagctacagtatactcatataagtaaaataattaaataaatctttttaaaaaatgataaaaaaaaaaaaaagaggttgtactggctggttttgtgtgtcaatttgacacaagatggagttatcacagagaaagagcctctcttgaggaaatgcttccatgagatccagctgtaaggcattttctcaattagtgatcaaggtgagagggcccagccccttgtgggtgggaccatctttgggctggtggtctgggttctacaagagaccaagctgagcaagccaggggaagcaagccagtaagtaacatccctccatggcctctgcatcagctcctgtttcctgacctgcttgagttccagtcctgacttcctttggtgatgaacagcaacgtggaaatgtaagctgcacaaaccctttcctctccaacctgcttcttggtcgtgatgtttgtgcaggcacagaaaccctgactgagacaacggtgaagagcagacacagtttatagccagtgatgagctttgcatcctcagccattgctttcaaaagccagatacatggaatattttttgtgaaggtcttttctgcattgtgattattttttccgagtgtttgtttttaggaaaatgtccctcatcgcagcctaacttctgcctggtctgcatgtctcgcttttcctgaactgtcttggcacaagtgggtgtggtgccagcagctgctccagtacttttgggtataccgatagatactctagttcagcctagtattgttgggtcctgaatttgcaacgtgaagaaaactctctccagtctcaggacttctacagggtcccaggaaaaggaacctggaccgtgtggaatgtctgccagggtgagggcagagtgtctaagtcagaaccgggtgccatgccatctttagaagctctgacttgccaccatgtgctgactggatgagtgtgtccccggctggggatggggctcagctagttggtagaatgcttacctggcatgcattggctcaggaggaaagaaggcagcagtgagggtctttttccaaggaacccaatacatgctcagaaaaataatcaactaaggatcaaaaactctcagaaaacaacttcacagatatttggacgcactgggattcatgcccaaaacaaaaaacaaaccaaaagaaaaaagaaaaatggaggtgtgagggtttcatgtctgtgggaggggggggggtatcttgatggccttcaccatgtggaaagaccaagcctaaaagtgggctgcaccatccctgagtttgcacctctggacggtagacgcctagagaaagccgggtgactgccagcctggcctgcattcattttctctgctcttgacccatggatggatgggactagctattgcagtaaatctccaaccccaataaacctgtgcaaagagctcacaactcagttgtaatatttataagctgcaggtctagattgggcagatttaccactacactgctctattccccagctgtgagccaactataagctactacagcctacagctgtgagttgagataaatctctatccccagtgctgctttttgtcaggtatttttaaattttaaaaaatatttatgtcgggcatggtggcgcacacctttaatgtcaggcaggcggatttctgagttcgaggccagcctggtctacaaagtgagttccaggatagccagggctatacagagaaaccctgtcttgaaaaaacaaaaaaaaaaaaaaaaaaaatatatatatatatatatatatatatatatatatatatatatatatatatatatatatatatatatatatatatagtgtttagactgcctgtgtatgtgtgtaccatgtgtgcctggttcccaagcaggtcagaagagggcatcggatctcctcaaactggagttgtgagatgccatgtgtgtatgcttagaattgaacctgggtcctctgctgagaaaaagtgctcttaaccgctgagccctctgtcagagtgctttctcagagcaacaggaatgaaactaagataccctgtgtggtgccagaagcctgtatgtaattctagtactggggaaagtagaggccagaggtcagaaatccaaggtcagccttggctacttggccagcctgggctaaatgagagccccaattcaaaaccaaaacaaacaacaacaaaaagtgtgtcctgtaccaagacaagtttattttgcaggagggttcttggtgaggttacttttagaaattgaccaaagggcaagttctttttattttattatttttaagttatattctgtgtgtgtgtgtactgtgtgtgtgtgtgagatataggttgagaatgagggtgcacacatgtgttcgtgcacatctggaggtcagagaacaaccttggacactggttctcttttgcccctttgacctgggtcccagggaatgaactcaggttgccaggcaagcatctttacctactgagccgtctcactaaccttcaacttggtcttctaaaacttttatcgtctttatttaagtgctttcacgtgtctcagtttatgccacgtgttgtatgaatgcccttggaggccagcggaaggcatcagatcacttggaaacggagttaaagccaattgtgtattgctcagtgtgggtgctgggaactgaactcggttccccagaaatagcagcaagtgttcatcgcagccgagacatctcaccagcccacaacattctcttcagaactaacttaggggcccatgagaactgccttaactcagtacccactaggatccaaacagctcccactaggccctaccttgtcatcaccttatcacctcgcatctaacacacaaggacttgaatcactcaaaccaaatctaccttagcaaaggctgaggccactgaataccaggtaaacgccagcaccaggctccttacagcccggagattaccaaactgctagagtcaatgccagattaaaaaaaaaaaaaaaaaaaaagaacatggggcggggtgagggttggggggagagggggcaggctgcagttgggacaaggaaaaacagagtggtagaggccactttaaaacataaccatcatgatttttacttatcaaaaagccaccaggagctggccttggtgacatataccggtcatcccagtacatagaaggcagccaagggctacacagggagacttctaaaatacagtagtaaaaataacagcaataggactggaaagatggctcagcagttaagagtactatctgctcttccgaaggtcctgagttcaaatcccagcaaccacatggtggctcacaaccatctgtacagctacagagtactcatatacattaaataaataaataaataaataaataaataaatctttaaaaaataaataataacaacaactaaggaatgaagaagactttttttttttttttttttttggttttcaaggcagggtttctctgtatagctctggctgtcctggaactcactctgtagaccaggctggcctcaaacccagaaatccacctgcctctgcctcccaagtgctgggattaaaggaatgtgccaccactgcccggcgaagaagacattttttaatgtctttttaacagacaactgttctctctgctcttcagtgaagaacaatttcctggtgccaaaaataggaaaggtgaatttgctgagtagacagcaaactctatctgggatacaataagtagatgatatgatatgggagaagatggcccaggctatgggggaaaggcttgatctgggaagtgtgtgtagggaactacggagcatctctcattcggtaagaattaactgggagcctccttaagctgagttttgaagcagggagaggtggaacacgcctataaccccagcactgcggaggttgaagcaggattgttgcaagatacagcgcagtcgaggctgcaatgtgagtggaaagacaggagggaagtctgggactggagggattggtctctgcccgagggctcaatactactgttcttgcagaagacccagctaatgacaaacgtcccttggtacaggaacagggagactaaagggacagagcgagcaggacagcaaagatgagaccacctttattgctgaaccagataaacagtgaggttgccttattgtacacagatccatttcttcaaatgccttcttgaaatgtcttctccaaaagccttcttcacactcctgtcacccgaagggtaggttagaaatgacgaatctcggggcacaccctgtatctaccaaacaccttgtgacctgtgtctcccaaagccaaacctgggtgactcactagaagccctgctggaaaagacgccgcgtgtctttacaaatccacagagccttctagcatatttcaagcggtttcggatccccacaggttttcaacagcttttgcggctcatgggcggcagagatcgccacctggtggccgagtgtgttaataacatttattaccttcctaggtcttaatcctcaagaattggactatcatattaaaagtaattacagttttagcacaattgtcttggacgttttttttttaaagatggagcccacagtgttgatctcctcctgcttgacttcaggcaagacaggaccagttgcctcatgttccagccacggtaccttccttggtgtgaaagttgatacccttaagctatgaacaaaagccaccccatccatgaggggcatttgtcagggatctcttcacaacaatgtgacataattgatgcccgtgacagagaagaccgggcagaccaaggaagtgttctatgtcaaaagagactgaagaaagccaagaatgttgagtgttggcacttagaatttcagcaccagggggtctgggacagggggatgatgagtttgaggttggcctgtgttaccagtatataaatagatagataggtagatagatagatagataactgaaactattgagactacatgcgtatctgcaccacaaaaccctaaattggatcccagacttaaaaacaaaaatgtgggtaagaaggcaaatctggcaaacaccctgacaagcttcatgaaccagcagtctgagttcagttcccaggacccatgtgtaagaggcagaagaattgaatccaaaatcaaatacttgatactaagggagacaaagtcaaaaagaaggaggaggaggaggaagaggagggggagaggaagaggaggaggaaagggaggaggagaaagaggaggagaaggaagaggatgaggaagaagaggagggggaagaggaagaagaggaagaggaagaagaggaggagaagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttactgctgaacaagcgtaccctttcttgttctgatatctgattggctggttcacctcagctgtcgtagctcaaactctctagactcttccaggtgcctttaggtgtttccatttccccaataatggagctgacctgccagcagtttcttttagtttttcgagacagggtttctctgtgtagccctggctgtcctggaactcactctgtagaccaggctggcctcgaactcagaaatccgcctgcctctgcctcccaggtgctggaattaaaggcgtgcgccaccacggcctggttcctgccagcagtttcttgactgctccccctcacatacaagtgtctgtaaagaaatggagctccctgaagttcagacttcctaatttctcttattcttgtggaggcctgctccttttaacataactgtagccattttgtatctccattctgctcaaaaggtgaaatcaagttctgacagaagccatctaggaaaggctatggcaagccagtgagtttcctggagatggcccactggtttgcatggtttcaatggggagacggctcagcgccagagacttcgtcccaggatcacttctcactgctgatgtgcctttcctgccactattacttagcccaatggttcctgggcatcagttaaccttattgggcaaatttcctgcagatcaacatgaagatggactttcatgaattgatgctgtttagatgaattaatgacttcatagaattcaaataattttaggaagaaagtttaaggagatgattttagtcgttttgtcagaaagatggaatagaattacaatcaagaatagaatgtggctgggcagtggtgacacacacctttaatcccagtacttgggatgcagaggcaggcagatttctgagttcaaggccagcatggtttatagagtgagttccaggatagccagggctatacagagaaaccctgtcaaaaaaaaaaaaaaaaaaaaaaaaaaaaagaatagaatgtgtccactcttcatagaacagtaagtaaaggctgcataataaggaacacaatgagctgtcatgactcacactgagaagagaaacaggcttgggacagaattgtgatcaaggaaaaacattcattctaggtcaggtccaaggatgaagccacagatgtgcaccatgataaagtgaggctatgtgaaactgttgctttgaacttataatgagcttatagaatgaaacattgctttgcagggccaaccagtgaggttgactgaagcaagtagaggtcctaaaaattcaattcccaacaaccacatgaaggctcacaacctcagctacagtgtatacataaaatcttttttaaaaaaagaaacattgctttgaacttattatcaacattcttctgtaattccccttttgtgtagcattttatctgttaggtaattttataaaaaaaacttttgtctaagaaggtataaattgccagaatgaaaaaaacaaagtgtggcttttggggctctgcaccatccactgaatgtatatatgtatatatctatattcagtatatatctgtccatatgtacatacacatagacacatatgttcataggtataagtgtaggcttagatttttcttctctttttttttctttaaagatttattttatttatatgaatacactgtagttgtcttcagactcaccagaagagggcatgggatcctattatagatggtgtgagccaccatgtggttgctgggaactgaactcaggtccactgatccatctctccagcccccaaagaaacactttttggttttttgagacagggtttctctgtatagccctggctgtccttgaactcactttgtagaccaggctggtctcgaactcaaaaaatccgcatgcctctgcctcctgagtgctgggattaaaggcatgcggccaacacacctggttcgcttagatttttcaaaacctactttaataagagctcctttttatttttattattattatttttaagatttatttatttattatatgtaagctgtactccagaagaggacatcagatttcgttacagatggttgtcagctaccatgtggttgctgggatttgaactcgggaccttcggaagagcagttggcgctcttaaccactgagccatctcgccagcccctatttttattatttttaaaggtttatttatttattatatgtaagtacactgtagctgtcttcagacacaccacaagagggcatccaatcttattacagatggttttgagccaccatgtgattggtgggatttgaattcaggacatccagaaaagcagtcagttctcttaaccagtgagccatctctccagccctaataagagctcttaaatactttgattccctttctagcccaccatcca

SEQ ID NO: 42 - DNA, 2700 bp, Mus musculus
ggttgttgttgttgttttctcctcttctagacaaagccattgggttcagtggtccctccggaaggccagtcatttcctgaggagatatcaggccagcccagacctcattgttcttggtttccagctatggccgccattacctgacaagtaccagagctggtctctgcgcgcctggagaggttgtcagagttgtttctgcttttcacacagcaggcttctggtctgtggcaggcaagagaattctgcccctgaggcatggccggaagacagaactagctgagtgcttcagtctgcagaagtctttcaggattcagctgaggtgggcctcagtcggcagacaagatgctcctggctctgggactcacgctggtgctctatgcaagcctccaggctgaggaaaactccttcaccatcaacagcatccatatggaaagcctgccatcatgggaggtgatgaatgggcagcaactgaccctggagtgccttgtggacatcagcaccacctcgaaaagcaggtctcagcaccgggtgctgttctataaggacgatgcgatggtgtataacgtcacctccagggagcacaccgagagctacgtcattcctcaggctcgggtcttccactccgggaagtacaaatgcacagtgatgctgaacaacaaggaaaaaaccacgattgagtacgaggtgaaggtgcatggcgtatccaagcccaaggtgacactggacaaaaaggaggtgacagaaggcggggtcgtgacggtcaattgttccttgcaagaagaaaagccaccgatcttttttaaaattgaaaaattagaagtggggacaaagtttgtcaagcgaaggatagataagacctccaacgagaactttgtgctcatggaattccccattgaggcgcaggaccacgtgttagtgtttcgctgccaagctgggatcctgtccggattcaaattgcaggagtcagaacccatcaggagtgaatacgtcaccgtgcaggagtccttctccactcccaagtttgaaatcaagccccctgggatgatcatagaaggggaccagctgcacattaggtgcatagttcaagtgacacacttggtccaggagtttacagaaattatcatccaaaaagacaaggcgattgtagccacctccaagcaaagcagtgaagctgtctactcagtcatggccatggtcgagtacagtggacactacacctgcaaagtggaatcaaaccgtatctccaaagccagtagcatcatggtcaacataacagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcgaaatgctctcgaagcccagtatttttcatgatgccaagtctgagatcataaaaggacatgccataggcatcagctgccagtccgaaaatggaactgcacccatcacttaccaccttatgaaagcaaagagtgacttccagactctcgaggtgacctccaatgacccagcaacattcacagataagcccaccagagacatggaataccagtgcagagcggataattgccattcccaccccgcggtgttcagcgagatcctgagggtcagggtgatagccccagtggatgaagttgtgatttccatcctgtcgagtaacgaggtacagtctggaagtgaaatggtacttcggtgctctgtgaaagaggggacgagcccaatcacgtttcagttttacaaagaaaaggaggacagacccttccaccaagcggtcgtgaatgacacccaagcgttttggcacaacaaacaagctagcaagaagcaggaaggacagtactactgtacagcctccaacagagccagcagtatgaggaccagtccccgaagcagcactcttgcagtcagagtcttccttgccccatggaagaaagggctcattgcggtggttgtcattggagtggtcatcgccaccttaatagttgcagccaaatgctacttcctgaggaaagccaaggccaaacagaaacccgtggagatgtccaggccagctgctccacttctgaactccaacagcgagaagatttctgagcctagtgtggaagccaacagccattacggttatgatgatgtttctggaaatgatgcagtaaaacccataaatcaaaataaagacccccagaacatggatgtagaatacacagaagtggaagtgtcctcccttgagcctcaccaagctctgggaacgagagccacagagacggtgtacagtgagatccggaaggtcgaccctaatctcatggaaaacagatactctgtaagtacacacgtcacacacactacgttaaaaatgcacccatgaagcttggtagtagctcatacctgaatcaccacactgaggagtgttgtggacgtttgaggccttccttggctacagaattccctttcaggactgcagtatgtggctgttgctgttgctttacaaaggtgttctatagaacaacgaactatttcccaattt

SEQ ID NO: 43 - protein, 730 aa, Mus musculus
MLLALGLTLVLYASLQAEENSFTINSIHMESLPSWEVMNGQQLTLECLVDISTTSKSRSQHRVLFYKDDAMVYNVTSREHTESYVIPQARVFHSGKYKCTVMLNNKEKTTIEYEVKVHGVSKPKVTLDKKEVTEGGVVTVNCSLQEEKPPIFFKIEKLEVGTKFVKRRIDKTSNENFVLMEFPIEAQDHVLVFRCQAGILSGFKLQESEPIRSEYVTVQESFSTPKFEIKPPGMIIEGDQLHIRCIVQVTHLVQEFTEIIIQKDKAIVATSKQSSEAVYSVMAMVEYSGHYTCKVESNRISKASSIMVNITELFPKPKLEFSSSRLDQGELLDLSCSVSGTPVANFTIQKEETVLSQYQNFSKIAEESDSGEYSCTAGIGKVVKRSGLVPIQVCEMLSKPSIFHDAKSEIIKGHAIGISCQSENGTAPITYHLMKAKSDFQTLEVTSNDPATFTDKPTRDMEYQCRADNCHSHPAVFSEILRVRVIAPVDEVVISILSSNEVQSGSEMVLRCSVKEGTSPITFQFYKEKEDRPFHQAVVNDTQAFWHNKQASKKQEGQYYCTNRASSMRTSPRSSTLAVRVFLAPWKKGLIAVVVIGVVIATLIVAAKCYFLRKAKAKQKPVEMSRPAAPLLNSNSEKISEPSVEANSHYGYDDVSGNDAVKPINQNKDPQNMDVEYTEVEVSSLEPHQALGTRATETVYSEIRKVDPNLMENRYSVSTHVTHTTLKMHP

SEQ ID NO: 44 - DNA, 3361 bp, Mus musculus
ggttgttgttgttgttttctcctcttctagacaaagccattgggttcagtggtccctccggaaggccagtcatttcctgaggagatatcaggccagcccagacctcattgttcttggtttccagctatggccgccattacctgacaagtaccagagctggtctctgcgcgcctggagaggttgtcagagttgtttctgcttttcacacagcaggcttctggtctgtggcaggcaagagaattctgcccctgaggcatggccggaagacagaactagctgagtgcttcagtctgcagaagtctttcaggattcagctgaggtgggcctcagtcggcagacaagatgctcctggctctgggactcacgctggtgctctatgcaagcctccaggctgaggaaaactccttcaccatcaacagcatccatatggaaagcctgccatcatgggaggtgatgaatgggcagcaactgaccctggagtgccttgtggacatcagcaccacctcgaaaagcaggtctcagcaccgggtgctgttctataaggacgatgcgatggtgtataacgtcacctccagggagcacaccgagagctacgtcattcctcaggctcgggtcttccactccgggaagtacaaatgcacagtgatgctgaacaacaaggaaaaaaccacgattgagtacgaggtgaaggtgcatggcgtatccaagcccaaggtgacactggacaaaaaggaggtgacagaaggcggggtcgtgacggtcaattgttccttgcaagaagaaaagccaccgatcttttttaaaattgaaaaattagaagtggggacaaagtttgtcaagcgaaggatagataagacctccaacgagaactttgtgctcatggaattccccattgaggcgcaggaccacgtgttagtgtttcgctgccaagctgggatcctgtccggattcaaattgcaggagtcagaacccatcaggagtgaatacgtcaccgtgcaggagtccttctccactcccaagtttgaaatcaagccccctgggatgatcatagaaggggaccagctgcacattaggtgcatagttcaagtgacacacttggtccaggagtttacagaaattatcatccaaaaagacaaggcgattgtagccacctccaagcaaagcagtgaagctgtctactcagtcatggccatggtcgagtacagtggacactacacctgcaaagtggaatcaaaccgtatctccaaagccagtagcatcatggtcaacataacagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcgaaatgctctcgaagcccagtatttttcatgatgccaagtctgagatcataaaaggacatgccataggcatcagctgccagtccgaaaatggaactgcacccatcacttaccaccttatgaaagcaaagagtgacttccagactctcgaggtgacctccaatgacccagcaacattcacagataagcccaccagagacatggaataccagtgcagagcggataattgccattcccaccccgcggtgttcagcgagatcctgagggtcagggtgatagccccagtggatgaagttgtgatttccatcctgtcgagtaacgaggtacagtctggaagtgaaatggtacttcggtgctctgtgaaagaggggacgagcccaatcacgtttcagttttacaaagaaaaggaggacagacccttccaccaagcggtcgtgaatgacacccaagcgttttggcacaacaaacaagctagcaagaagcaggaaggacagtactactgtacagcctccaacagagccagcagtatgaggaccagtccccgaagcagcactcttgcagtcagagtcttccttgccccatggaagaaagggctcattgcggtggttgtcattggagtggtcatcgccaccttaatagttgcagccaaatgctacttcctgaggaaagccaaggccaaacagaaacccgtggagatgtccaggccagctgctccacttctgaactccaacagcgagaagatttctgagcctagtgtggaagccaacagccattacggttatgatgatgtttctggaaatgatgcagtaaaacccataaatcaaaataaagacccccagaacatggatgtagaatacacagaagtggaagtgtcctcccttgagcctcaccaagagaacggaaggctcccttaatggaacttaagacagtcaaggcagtgcacgtccctgggaggtcgtccatgtcccgagaagagcagccgattcctggattgcgagagtcctgtgcacgtatttatgagcctgtccccaccgaaagcagtaatccttcaggccaagccatccaattttaaaccccgctgccttgttcatgttgggtatacagagactcagaggcgctagttaatggccagcctgacctgtcttccttgtgtttcggggggtgaaaggaggttccaggagaataatgccctggaatattctgaggctgaaatgttgtgtctcggatagacagagtacttctccgtgggtcctcctgcacagaagcccccttctgctctgttgtcaatcactgggttagttttttgttttgttttgtttctgttgttctcttctttctgggttgatcttaatctttggaaatacacagtgctgctcaggtttgcctggttcccctgtgtgaccttcccccccacacacacacaaagtcaaccagctgactgggagcaatgctcgtggaatggccagtcacttgaagacagacctcaagccagcaatggcaactggagcgagcacttaaagcgcaccttgatcttcctttccgttccatgccgaaggcccaaagaagagaaatggctggctacaacaactgttattatttttttaatagtaaaaggaaatatgtacttttctcactaatttttctttatttattccccactaaagaaacggtttcctaaggtctgagctgtttcccagggtgggctagagtgggtgggcaggagctgccgacattttgtgtactatacctaaccctcctcgccttctccgtttgcctcagccacccggctccagggcccctgaggggagttgtattaaataaaattgatttttactcttc

SEQ ID NO: 45 - protein, 695 aa, Mus musculus
MLLALGLTLVLYASLQAEENSFTINSIHMESLPSWEVMNGQQLTLECLVDISTTSKSRSQHRVLFYKDDAMVYNVTSREHTESYVIPQARVFHSGKYKCTVMLNNKEKTTIEYEVKVHGVSKPKVTLDKKEVTEGGVVTVNCSLQEEKPPIFFKIEKLEVGTKFVKRRIDKTSNENFVLMEFPIEAQDHVLVFRCQAGILSGFKLQESEPIRSEYVTVQESFSTPKFEIKPPGMIIEGDQLHIRCIVQVTHLVQEFTEIIIQKDKAIVATSKQSSEAVYSVMAMVEYSGHYTCKVESNRISKASSIMVNITELFPKPKLEFSSSRLDQGELLDLSCSVSGTPVANFTIQKEETVLSQYQNFSKIAEESDSGEYSCTAGIGKVVKRSGLVPIQVCEMLSKPSIFHDAKSEIIKGHAIGISCQSENGTAPITYHLMKAKSDFQTLEVTSNDPATFTDKPTRDMEYQCRADNCHSHPAVFSEILRVRVIAPVDEVVISILSSNEVQSGSEMVLRCSVKEGTSPITFQFYKEKEDRPFHQAVVNDTQAFWHNKQASKKQEGQYYCTNRASSMRTSPRSSTLAVRVFLAPWKKGLIAVVVIGVVIATLIVAAKCYFLRKAKAKQKPVEMSRPAAPLLNSNSEKISEPSVEANSHYGYDDVSGNDAVKPINQNKDPQNMDVEYTEVEVSSLEPHQENGRLP

SEQ ID NO: 46 - DNA, 3418 bp, Mus musculus
ggttgttgttgttgttttctcctcttctagacaaagccattgggttcagtggtccctccggaaggccagtcatttcctgaggagatatcaggccagcccagacctcattgttcttggtttccagctatggccgccattacctgacaagtaccagagctggtctctgcgcgcctggagaggttgtcagagttgtttctgcttttcacacagcaggcttctggtctgtggcaggcaagagaattctgcccctgaggcatggccggaagacagaactagctgagtgcttcagtctgcagaagtctttcaggattcagctgaggtgggcctcagtcggcagacaagatgctcctggctctgggactcacgctggtgctctatgcaagcctccaggctgaggaaaactccttcaccatcaacagcatccatatggaaagcctgccatcatgggaggtgatgaatgggcagcaactgaccctggagtgccttgtggacatcagcaccacctcgaaaagcaggtctcagcaccgggtgctgttctataaggacgatgcgatggtgtataacgtcacctccagggagcacaccgagagctacgtcattcctcaggctcgggtcttccactccgggaagtacaaatgcacagtgatgctgaacaacaaggaaaaaaccacgattgagtacgaggtgaaggtgcatggcgtatccaagcccaaggtgacactggacaaaaaggaggtgacagaaggcggggtcgtgacggtcaattgttccttgcaagaagaaaagccaccgatcttttttaaaattgaaaaattagaagtggggacaaagtttgtcaagcgaaggatagataagacctccaacgagaactttgtgctcatggaattccccattgaggcgcaggaccacgtgttagtgtttcgctgccaagctgggatcctgtccggattcaaattgcaggagtcagaacccatcaggagtgaatacgtcaccgtgcaggagtccttctccactcccaagtttgaaatcaagccccctgggatgatcatagaaggggaccagctgcacattaggtgcatagttcaagtgacacacttggtccaggagtttacagaaattatcatccaaaaagacaaggcgattgtagccacctccaagcaaagcagtgaagctgtctactcagtcatggccatggtcgagtacagtggacactacacctgcaaagtggaatcaaaccgtatctccaaagccagtagcatcatggtcaacataacagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcgaaatgctctcgaagcccagtatttttcatgatgccaagtctgagatcataaaaggacatgccataggcatcagctgccagtccgaaaatggaactgcacccatcacttaccaccttatgaaagcaaagagtgacttccagactctcgaggtgacctccaatgacccagcaacattcacagataagcccaccagagacatggaataccagtgcagagcggataattgccattcccaccccgcggtgttcagcgagatcctgagggtcagggtgatagccccagtggatgaagttgtgatttccatcctgtcgagtaacgaggtacagtctggaagtgaaatggtacttcggtgctctgtgaaagaggggacgagcccaatcacgtttcagttttacaaagaaaaggaggacagacccttccaccaagcggtcgtgaatgacacccaagcgttttggcacaacaaacaagctagcaagaagcaggaaggacagtactactgtacagcctccaacagagccagcagtatgaggaccagtccccgaagcagcactcttgcagtcagagtcttccttgccccatggaagaaagggctcattgcggtggttgtcattggagtggtcatcgccaccttaatagttgcagccaaatgctacttcctgaggaaagccaaggccaaacagaaacccgtggagatgtccaggccagctgctccacttctgaactccaacagcgagaagatttctgagcctagtgtggaagccaacagccattacggttatgatgatgtttctggaaatgatgcagtaaaacccataaatcaaaataaagacccccagaacatggatgtagaatacacagaagtggaagtgtcctcccttgagcctcaccaagctctgggaacgagagccacagagacggtgtacagtgagatccggaaggtcgaccctaagaacggaaggctcccttaatggaacttaagacagtcaaggcagtgcacgtccctgggaggtcgtccatgtcccgagaagagcagccgattcctggattgcgagagtcctgtgcacgtatttatgagcctgtccccaccgaaagcagtaatccttcaggccaagccatccaattttaaaccccgctgccttgttcatgttgggtatacagagactcagaggcgctagttaatggccagcctgacctgtcttccttgtgtttcggggggtgaaaggaggttccaggagaataatgccctggaatattctgaggctgaaatgttgtgtctcggatagacagagtacttctccgtgggtcctcctgcacagaagcccccttctgctctgttgtcaatcactgggttagttttttgttttgttttgtttctgttgttctcttctttctgggttgatcttaatctttggaaatacacagtgctgctcaggtttgcctggttcccctgtgtgaccttcccccccacacacacacaaagtcaaccagctgactgggagcaatgctcgtggaatggccagtcacttgaagacagacctcaagccagcaatggcaactggagcgagcacttaaagcgcaccttgatcttcctttccgttccatgccgaaggcccaaagaagagaaatggctggctacaacaactgttattatttttttaatagtaaaaggaaatatgtacttttctcactaatttttctttatttattccccactaaagaaacggtttcctaaggtctgagctgtttcccagggtgggctagagtgggtgggcaggagctgccgacattttgtgtactatacctaaccctcctcgccttctccgtttgcctcagccacccggctccagggcccctgaggggagttgtattaaataaaattgatttttactcttc

SEQ ID NO: 47 - protein, 714 aa, Mus musculus
MLLALGLTLVLYASLQAEENSFTINSIHMESLPSWEVMNGQQLTLECLVDISTTSKSRSQHRVLFYKDDAMVYNVTSREHTESYVIPQARVFHSGKYKCTVMLNNKEKTTIEYEVKVHGVSKPKVTLDKKEVTEGGVVTVNCSLQEEKPPIFFKIEKLEVGTKFVKRRIDKTSNENFVLMEFPIEAQDHVLVFRCQAGILSGFKLQESEPIRSEYVTVQESFSTPKFEIKPPGMIIEGDQLHIRCIVQVTHLVQEFTEIIIQKDKAIVATSKQSSEAVYSVMAMVEYSGHYTCKVESNRISKASSIMVNITELFPKPKLEFSSSRLDQGELLDLSCSVSGTPVANFTIQKEETVLSQYQNFSKIAEESDSGEYSCTAGIGKVVKRSGLVPIQVCEMLSKPSIFHDAKSEIIKGHAIGISCQSENGTAPITYHLMKAKSDFQTLEVTSNDPATFTDKPTRDMEYQCRADNCHSHPAVFSEILRVRVIAPVDEVVISILSSNEVQSGSEMVLRCSVKEGTSPITFQFYKEKEDRPFHQAVVNDTQAFWHNKQASKKQEGQYYCTNRASSMRTSPRSSTLAVRVFLAPWKKGLIAVVVIGVVIATLIVAAKCYFLRKAKAKQKPVEMSRPAAPLLNSNSEKISEPSVEANSHYGYDDVSGNDAVKPINQNKDPQNMDVEYTEVEVSSLEPHQALGTRATETVYSEIRKVDPKNGRLP

SEQ ID NO: 48 - DNA, 3441 bp, Mus musculus
ggttgttgttgttgttttctcctcttctagacaaagccattgggttcagtggtccctccggaaggccagtcatttcctgaggagatatcaggccagcccagacctcattgttcttggtttccagctatggccgccattacctgacaagtaccagagctggtctctgcgcgcctggagaggttgtcagagttgtttctgcttttcacacagcaggcttctggtctgtggcaggcaagagaattctgcccctgaggcatggccggaagacagaactagctgagtgcttcagtctgcagaagtctttcaggattcagctgaggtgggcctcagtcggcagacaagatgctcctggctctgggactcacgctggtgctctatgcaagcctccaggctgaggaaaactccttcaccatcaacagcatccatatggaaagcctgccatcatgggaggtgatgaatgggcagcaactgaccctggagtgccttgtggacatcagcaccacctcgaaaagcaggtctcagcaccgggtgctgttctataaggacgatgcgatggtgtataacgtcacctccagggagcacaccgagagctacgtcattcctcaggctcgggtcttccactccgggaagtacaaatgcacagtgatgctgaacaacaaggaaaaaaccacgattgagtacgaggtgaaggtgcatggcgtatccaagcccaaggtgacactggacaaaaaggaggtgacagaaggcggggtcgtgacggtcaattgttccttgcaagaagaaaagccaccgatcttttttaaaattgaaaaattagaagtggggacaaagtttgtcaagcgaaggatagataagacctccaacgagaactttgtgctcatggaattccccattgaggcgcaggaccacgtgttagtgtttcgctgccaagctgggatcctgtccggattcaaattgcaggagtcagaacccatcaggagtgaatacgtcaccgtgcaggagtccttctccactcccaagtttgaaatcaagccccctgggatgatcatagaaggggaccagctgcacattaggtgcatagttcaagtgacacacttggtccaggagtttacagaaattatcatccaaaaagacaaggcgattgtagccacctccaagcaaagcagtgaagctgtctactcagtcatggccatggtcgagtacagtggacactacacctgcaaagtggaatcaaaccgtatctccaaagccagtagcatcatggtcaacataacagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcgaaatgctctcgaagcccagtatttttcatgatgccaagtctgagatcataaaaggacatgccataggcatcagctgccagtccgaaaatggaactgcacccatcacttaccaccttatgaaagcaaagagtgacttccagactctcgaggtgacctccaatgacccagcaacattcacagataagcccaccagagacatggaataccagtgcagagcggataattgccattcccaccccgcggtgttcagcgagatcctgagggtcagggtgatagccccagtggatgaagttgtgatttccatcctgtcgagtaacgaggtacagtctggaagtgaaatggtacttcggtgctctgtgaaagaggggacgagcccaatcacgtttcagttttacaaagaaaaggaggacagacccttccaccaagcggtcgtgaatgacacccaagcgttttggcacaacaaacaagctagcaagaagcaggaaggacagtactactgtacagcctccaacagagccagcagtatgaggaccagtccccgaagcagcactcttgcagtcagagtcttccttgccccatggaagaaagggctcattgcggtggttgtcattggagtggtcatcgccaccttaatagttgcagccaaatgctacttcctgaggaaagccaaggccaaacagaaacccgtggagatgtccaggccagctgctccacttctgaactccaacagcgagaagatttctgagcctagtgtggaagccaacagccattacggttatgatgatgtttctggaaatgatgcagtaaaacccataaatcaaaataaagacccccagaacatggatgtagaatacacagaagtggaagtgtcctcccttgagcctcaccaagctctgggaacgagagccacagagacggtgtacagtgagatccggaaggtcgaccctaatctcatggaaaacagatactctagaacggaaggctcccttaatggaacttaagacagtcaaggcagtgcacgtccctgggaggtcgtccatgtcccgagaagagcagccgattcctggattgcgagagtcctgtgcacgtatttatgagcctgtccccaccgaaagcagtaatccttcaggccaagccatccaattttaaaccccgctgccttgttcatgttgggtatacagagactcagaggcgctagttaatggccagcctgacctgtcttccttgtgtttcggggggtgaaaggaggttccaggagaataatgccctggaatattctgaggctgaaatgttgtgtctcggatagacagagtacttctccgtgggtcctcctgcacagaagcccccttctgctctgttgtcaatcactgggttagttttttgttttgttttgtttctgttgttctcttctttctgggttgatcttaatctttggaaatacacagtgctgctcaggtttgcctggttcccctgtgtgaccttcccccccacacacacacaaagtcaaccagctgactgggagcaatgctcgtggaatggccagtcacttgaagacagacctcaagccagcaatggcaactggagcgagcacttaaagcgcaccttgatcttcctttccgttccatgccgaaggcccaaagaagagaaatggctggctacaacaactgttattatttttttaatagtaaaaggaaatatgtacttttctcactaatttttctttatttattccccactaaagaaacggtttcctaaggtctgagctgtttcccagggtgggctagagtgggtgggcaggagctgccgacattttgtgtactatacctaaccctcctcgccttctccgtttgcctcagccacccggctccagggcccctgaggggagttgtattaaataaaattgatttttactcttc

SEQ ID NO: 49 - protein, 725 aa, Mus musculus
MLLALGLTLVLYASLQAEENSFTINSIHMESLPSWEVMNGQQLTLECLVDISTTSKSRSQHRVLFYKDDAMVYNVTSREHTESYVIPQARVFHSGKYKCTVMLNNKEKTTIEYEVKVHGVSKPKVTLDKKEVTEGGVVTVNCSLQEEKPPIFFKIEKLEVGTKFVKRRIDKTSNENFVLMEFPIEAQDHVLVFRCQAGILSGFKLQESEPIRSEYVTVQESFSTPKFEIKPPGMIIEGDQLHIRCIVQVTHLVQEFTEIIIQKDKAIVATSKQSSEAVYSVMAMVEYSGHYTCKVESNRISKASSIMVNITELFPKPKLEFSSSRLDQGELLDLSCSVSGTPVANFTIQKEETVLSQYQNFSKIAEESDSGEYSCTAGIGKVVKRSGLVPIQVCEMLSKPSIFHDAKSEIIKGHAIGISCQSENGTAPITYHLMKAKSDFQTLEVTSNDPATFTDKPTRDMEYQCRADNCHSHPAVFSEILRVRVIAPVDEVVISILSSNEVQSGSEMVLRCSVKEGTSPITFQFYKEKEDRPFHQAVVNDTQAFWHNKQASKKQEGQYYCTNRASSMRTSPRSSTLAVRVFLAPWKKGLIAVVVIGVVIATLIVAAKCYFLRKAKAKQKPVEMSRPAAPLLNSNSEKISEPSVEANSHYGYDDVSGNDAVKPINQNKDPQNMDVEYTEVEVSSLEPHQALGTRATETVYSEIRKVDPNLMENRYSRTEGSLNGT

SEQ ID NO: 50 - DNA, 83517 bp, Homo sapiens
  misc_feature (1)...(83517): n = A,T,C or G
tagggagggtcagaatcttgcagcctccagctgcatgactcttaaaccataatttctaatcttgtggctaatgttagtcctaaaaaggcaatctagtccccaggcaagaaggaggtctgctttgggaaagggctgttattgtctttgtttgtttgtttgtttgttgtttttgagatggagtcttcgctctgttgcccaggctggagtgcagtggcgggatctcagctcactgcaacctccacctcccaggttcaagcaattgtcctgtgtcagcctcccgagtagctgggactacaggtgcccgccaccacacccagctaatttttgtatttttagtagagacagggtttcaccatattggtcaggctggtctcgaactcctaacctcaggtgatccaccagcctcagcctcccaaagtgctgggattacaggcgtaagctacctcacccagccaccactgcacccgacttatctttgttttaaactataaaccaagtttctcccaaagttagttcagcctgcctaggaaaggacacggacagattggaggttagaagcaaatggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccttttaaggaacagggccaggaaagtatgcagtttctagggactaataagcaggcttggatccccaaataaagggaatcaggctatcccttataggagtcttatctctcagtgggggtgggtgggtatgtttccataccttctaggtggtcaagagcatgcttctctgatccaaacatgcaaagaactgagtactcccctataactgccattagccatcccttgaagtatatttcctacctagttattacacattaaggctaaaagctctctcataatgtaatctctcataccctaaatgtaaaaaacatcaggtaacacaatgcaaaacagagcagagcctgacttttaaccaaatctcttattaccactctagccaggacaaatagctgatattcctggcttttggacttgaccaaaggtaaccttccaggtgaaacgaataagacttaactaggattatgacttaaccatggatgtgcatttttttgttttttttttttgtttgtttgttttgtttttttttgagatggagtcttggtctgttgcccaggcgagagtgcagtggcacgcacaatctcagctcactgcaacctctgtctcctaggctcaagctatcctcttacgtcagcccccctagtagctgggattacaggcatgcgcaaccacgcccagcgaatttttgtatttttagtagagatggggtttcttcatgttggccaggctggtctcaaacttctgacctcaggggatccacccgcctcggcctctttttaaagtgctgggattacaggtgtgagccactgtgtccggcatgtgtggtattttcaaagagtgcagtggcacgcacgatctcagctcactgcaacctctgtctcccaggctcaagctatcctcttacatcagccccccagtagctgggattacaggcacgtgccaccatgcccagctaatttttgtatttttagtagagacagggttttcgtcatgttggccaggctggtctcaaacttctgaccttagggatccacctgcctcggcctccttttaaagtgctgggattacaggcatgagccactgtgcctggtgtgtgtggtattttcaaagaggtggtaagcagttgttacaaggatctagaatcgccaaatgtagcccagagaaaggaaaattcaagatgggaagtcagaagttgttcatggtagggaagataattaataactggcaaaagtcacacagacagcaaaccagaaagcacttattccctaagccgggaattgaaccgaggccaccactgtgaaaaaaaagataaggccttagccacttagctagggtgccgggcaatttctagtactcttcccagaaggagcctaaagcagtcaatttcgagcttgcaaaggcttttagctgctcaagttaatttttagagctaaatatgatatgaacctccaaaattcccacccttcagatggcagaagccaagagaaagtaccctgacatggtcacagggttaaaggatcaagctcccgcctcacctccccgagtagctgggattacgggtgcttgccaccatgcccggctgatttttttttttttttttaattttagtagagatgaggtcttgctatatttcccaggctggtcttgaactcctgagctcaagcgatcctcccacatcagcctcccaaaatgctgggattacaggggtacaccaccatgcccagctgaaattacccttttaaaccaaagccaataaggatctgggtaggcccttagctgccagcagaagtgacctatcctaagagatgatttgtcaagattttgttagtggagagaagacgattccagaaaatctgggtgtttaccacaggctgagcacaaggaaggaaggaaggctttgggtttccttgtagggacaggggacaagtaagggctctggtgactctgtcttgctgtcttgtatccggaatggcctgggctgccgcctgggagaatgctgcactccctaggtcccaaagtgatgccagtggacctccagacccccttcagggaagggggtgctgaggattctgggaagactacatcagctgacctgagtgaacttgtttcttgtttgtttgttttgcttgtttgcttgtttgtttgagacagggtcttgctctgtagcccaggctggagtgcagtggtgtgatcttggctcactgtaacctccatctcccaggctgaggtgatcctcccacctcagcctcctgagtagatgagcctacaggtgcgcaccaccacacctggctaattttttgtatttattgtagagtcaaggtgtcactgtattgctcaggctggtcttgaattcctgggctcacgtgatccttccacactagcctcccaaagtgctgggattacaggagtgagccactgcgcctggcctcaactttttaaatttaatttcaagtgactcaaaagaaaaacaagcgaaaataaaaataaagtgttaaggcataaacagttaatgggcagtcagtttcctccctagagcttttgaaattacagacacttgacaatgacgccatctagtggaaggttagcaggtcagacgaaacccatctatttctcctgattcttgctctgtcagtccacagctctgaataagtgagttttgctggccatcccaggagtggactagccccaattgtggggcatcagcacccaggaacaacatcctatgaatggtctttcctgcttctctgagtttgctgggctctcctctggtctttcaagttccaaagagaagaatctagcacttactgagtacctcctggttaaagatcagttcattagatgggccagctgactccattctcataatgaccctgtgacgtgttctgtttcacacatgaaaaaacccagcctggtcaacatggcaagtcctcatctctacaaataatttaaaaactagtcagatatggtggggcatgcctgtggtcccagctactggggaggctgaggcaggaggagtgcttgagccccggagctcaaggctgtagtgaggcgtggtcacaccactgcactgcagcctgggcaacagaacaagaccctgtcaaaaataaataaataaataaaaaggaaactgtaactataaaggtagtctgtctctttgtaggaaggctgaaaatacttgtttgtacatagtgctagaagagccttactgttggaatttacagagggagaagctgagatatttgctcaaagttgcttgctactcaatgggaatggtgtttgggctgaaacgcaagttttttgggggcaaaaaacttgcggtgagcactgtagcctcgacctccatggctcaggtgatcctcctgcctcagcctccccagtagctgggactaaaggcatacttcatcatcacacctggctaattttttttatttgtggagacgaggtcttgccgtgttgcccaggctggtctcctgaactcaagcgatcctccctccttggcctcccagagtgctgggattccaggcatgagacaccatgcctggcctactttatatattttcaatgtactatttctgcattacatattttatgtactttttaatatcaatagtatgtctgtattagaaataacaatgtaaaagtgaaataagcactgggagcgtccaaagctattttaaaggtgttgggggtggccaggtgcagtggctctcgcctgtaatcccagcaccttgggaagctgaggcgggtggatcgacttgaggccaggagtttgagaccagcttgggcaacatggtaaaaccccgtctctactaaaaatacaaaaagttagctaggcatggtggtgcacccctgtaatcccaggtacttgggaggctgaggcacgagaatcacttgaacccacgaggtggaggttgctctgtctcaaaaaaaaaagaaaaaagcgtttaggagaagctgcggctgataaattacaaatagatgggttttcgtctgacctgctaatcttccactagatggcgtcattgtcaagtgtctgtaatttcaaaagcgctagggaggaaagactgcccattaattgtttatgccttaacactttatttttattttcgcttgtttttcttttgagtcacttgaaattaaagaaaaaaaagctgaggccaggcacagcggctcactcctgtaatcccagcactttgggaggccagtgaggaaggatcgcgtgagcccaggaattcaagactagcctgagcaatatagtgagacctcgtctctgcaagaaatacaaaaaattagccaggtgtggtggcgcacacctgtagtctcatctactcaggaggctgaggtgggaggattacctgagcctgggagatgaaggttacagtgagtacagtgagccgagatcacaccactgcactccagcctgggctacagagcaagactctgtctcaaacaaacaaacaaacaaaacaaacagacaagaaacaagttgaagttcccttcagaaataccctcctgcttcaagcctatagagggtaaaccaaatgaggtgctcgttaaaagaatttagtccttacatgaaaaataccatcaaatgtatgtagagtttcttttagtcctgcagaaatgcatacctgataccttgattatcacagagaaaaatgtttttggctactttaaaatgttccataattctgagcaggctggcagtcctaccttttcaccatcaaaaaccccccattatttttattatgtatttatttattttatgttttgaggcagggtctcgctctgttgcccaggctggagtgcagtggcacaaccatggctcactacagccttgaactccagggcctcatcctcccaactcagcctccctaatagctgggactacaggcatgcaccaccaagcccagctaattgttttgttttgttttgttgttgtttgtttgttttagtgatggagtctcactatgctgcccaggccagtctcaaactcctggactcatgtgatcctcctgcctctgcctcccaaagtgttgtgattataggcatgagccaacactcctggccccttcattatttgtattttataaatctcattattgggaatattttatccaaaatagcattaactaagtagtcaatgatttttctatttgtatttatatgtatatttgattaattaaagtccccagtagataagggacaaccttgctaaattgataaaactccatccctgccgggcgcagtgactaattcctgtaatcccagcactttgggaggccaaggcgggtggatcacttgaggtcaggagttcgagaccatcctggccaacatggtaaaaccccatctctactaaaaatacaaaagtaagctgggcatggtggcaggtgcctgtaatcccagctactcagcaggctgaggaagaaaattgcttgaacccaggaggtggaggttgcagtgagctgagatcacaccactgcactccagcctgggtgacagagcaagactctgtctgtctcaaaaaaaagagagagagagagagagaatgcatctccttccttcttgaaatgcccagattgccgtggtcatatcattgatgagctaagtaatgggattcttgggcttataagtttacagtggctgaagcctccactgtatggggcagtttttgtgaaatcctctagtaccggaatggcaccatggaagtggaaggaatagagtggaatgtcattgagtcttcctcattcaaaaaaaagagcccctttgcagatatagctgtccatatccatgggttccagattcatggattcaaccaaccgtggatagaaaatattcagaaaaaaattccacagtttcaaaagttgaaacttgaattttccacgtgctgagtactatgttgaatcccccacaaacgaaatgatgtgcagcatcttatgtggttttataagtaatctatagatgatttttttttttacttctccttatggagcagagctaactcataggcagtacacctagagttggccataagtaatctagagattattttaaatatacagaagggtgtacctaggttatatgctaatactatgccattttacagaaaagacttgagcatcctgagattttggtatctgtgggggtctggtacaatcccccatggatatcgagggacaacagtattcacaaagaaaaaagtttaattacaccaacagcacatgtaattaagtctccaagactccatctccgatgaggtgaatttaaagaatgcgttattatgattttggtagttggtcagaatttcgtatactggatagctgagagccagacctactagcaagtagctttgtgttgaccatggacaagtggaactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtctcgaactcccaacctcaggtgatccacctgcctcagcctcccgaagtgctgggattacaggcgtgagccactgcgcccagcccagcaaatactttcttagtgtaagtatatcccatgcaatatgcaaggatgtcccatctgagacatacttatattaaaaatagtatttattgcttatctgaaatttaaatgggcatcctgtatctttattgacgaaattcgggaaccctacaatttgtgaagacagagttgtacaagcatcaccacgatccagttgagcacattttcttcacccccaaaagttccctcttgcccaatggcagtcgtcctccgatccctctccaagtcccaggcaacctctggtcggcatcctgtctctatagatttggagaagactgtatttttaagtggagagacttggctgttacataactgtttagcacccgagtatttgcatgaagagtttcatttcattttttcaagtggaaccatggaggagagtggctgcccaaggtggggtttgtcttttgctgtctgagtggcccctgggatgcaggtatgtccattatttaaatctcttggtgtttacagaccacatgggtaacccctgttgtggcaaggctgagggcctcttcacctgtcactgagtgtggggactcttttcaggcctgggcagggcaggaagtctggaggggatatcaggtgatcagagggccattcgagaatgctgcaggctacagtgacaaaatgctggtcctgggctatctgagaccagtcctggaatgacttaactaaattaaatcttatgaatcaaggtgcctagcaccgtgcctgttgcctaaagtgtagctggaaaatagtctcccacgaatccagagtgacatttgctccatacccagttgggcctaagcctctagatctagagatatccatgaagaatggctcttgctttaagaacttaattctttagtgactaatgtttctagagcattaaccgcaggcaagcattttctaagagctttacatatgttaatgtccaatcctcacagacacactgtgaggcagatgctcgcattctctccatcttgcctatgaagaaatcaaggctcagagaagttaagcaaatcccctgaggtcacacagctagtctgggcctagaagagccttttctcctactattactctgtgttgcttcataatatggtgtaagttctgtgggagcccagaaagcaaggcatctgagctactgggaaggagggatgagacaagtaccctgaggagttagctgaccaaggaagcagggaacagcatttcaagcagaaggaacagcacatgcaagggttacaggcaagagaccgtggcctgcataaagagtggctgatgacgtttgggataaacgacttcccagaacatttcaaaaaaactcaaatgttttctttggggaaaatagtctgattttggcaagagaaagaatctcagaagagagccttgagaccttcaggagctattgttaacttggtgaattgtctctggtgcatctctctccctcacaaggcctgtttgttcttctgtgataaaagggctaatagcacctgtgctgtgggctcatttaatagaacacagtcgtgtgtagggcgtaatagaagagaatggaatggaataatgtaggtggcatgcatcgagagcttcgcatgtggtggccacccaggtgtggcacagccctgggccccgacgcatccgctcgggcacccatgccttactgacacattgaagaggagctgggaatttgttttccatctggcagagccccttccgtcttcctctacctgcggttctgggggctcagtctggagaggcgccaggcggctaactgactctggcattgggaatgcgtttgcagggagccaggggaagggagaagtcttactgccggctccctccaggctcccttcctcgtgatttatcactatggaaactgagctcctttcctcttcgcgctgccggctggtgggggtgcacattgttgatgccgttgccccacagatcagaagttccttcctctttcctgctgcagaaatgccacagtaacctacgtggcccaagaactgcagctcacacctgaagagcccagtcttgggaaaaacaatctcatcggattccccaggggttacgggggccttctgggtaagcagagccggcctgagaacaatgtcaggggagaacaatgcagccagcgggctgagctggtggccctgctgttcctcttccttcagcttccctagttgggggttaaaaatggatttacaggcagtcgcaagtatatcatgttaggcggcagaaaactgaaactcagagtctcttagtgtgggcaaagtctcccgcgacaacccacttgctgcaggtgcccagccctgcatatgcccacccatgacatatgcccacccactgcatttgcccactcactgcatatgcctacccatcacatatgcccacccactgcatatgcccacccactgcatatgcccacccactgcgtatgcccaccccctgcacatgcccacccactgcacatgcccacccactgtgtatgcccacccactgcgtatgcccacccactgcacatgcccatccactgcacatgcccatccactgcgtatgcccacccacagcatatgcccacccactgcacatgcccacccactgcacatgcccacccactgcatatgcccacccactgcacatgcccatccactgcatgtgcccactcactgcatatgcccactcatgacatatgcctgtccatttcatgtgcccacccatgacatatgcccacccatgacattcccacctagtgcgtgtgcctatccactgcatatacccaacccctgcatatgcccacccattgcatatgcttgcccattacacatgcctatccactgcatatacccatccactgcatatgcccacccaccgcatatacccactcactgcatatgcccatccactacatatacccactcactacatatacccactcactacgtatacccactcactacatatgcccacccactgcatatgtcctcccatcacatatgctcacccactgcacaggcctggtgagagctggctctgctggacttggtctggccctccgtaaccattccttagaggccagtgcctggattacagcaccctgggcatggcatcacatgtacctgtgccaggtcctagactcaaggacacagggcaaggggggattccagagacaacaaaggaagctccctggccaggaagtcctgagacactgccaggcccagcagtccccttgctggccacacagacaagacatggccaacctcagggcctcagggtccttctctgtaagttgacctaagggattcctctgtagcctcatcctatgggggatgggagagagggagctaagagcacctcctacttgcccatctctctcttaagagaggttcatctaagagtagctttctggggaaactggccttcaaacgacctgggagaaaaacatttcatttaggagctgaggcttgtcaatgcatctcacaatgatttgcagaaatcccctttacctccctgaatatacaagatcttttctaggtgcaaaatgttcctgtttgttttccgtttagaatttccccttattgggagcatattttctccctctcaccctcagagaaaatttccaggttccttccacattctaaagagcaatgtgaaaattcaaggttttctgttttgttttgttttgttttttttgagactaaatctcggtctattgcccaggctggagtgcagtggtgcaatctcagctcactgcgacctccacctcccgggttcaagcgaattctcctgcctcagcctcctgagtagctgggcccacggcacgtgccaccacacctggctaatttttgtgtttttagtagagacagggtttcaccatgttggcaaggctggtctccaactcctgacctcaagtgatcctcctgcctcagcctccaaaagtgctgggattacaggtgtgagccatggcatccagccctattttttaaatagaaatatttttattgagataatagtacatttgcatgcatttgcagtaaataatacagagatatgtgccagtttcccctaatggtaacattttgcaaagctacagtacaccatcacaaccaagttttctgggttttgtttatttgtttgttttgtttttgagacagggtctcgctctgttgctcaggatggagtgccatggcccaatcatggctcacagtagcctccacctcccgactcaagcaatcctcccacctcagcctcccgagtagctgggaccacaagcatgtacccccatgcctggctaattaaaaaacaaaattcatgtagagatggggtgtctcactatgttgtccaggggggtctcgaactcctgggctcaagtgatcctcccgcctcagcttcccaaaatgctgggattacagtcaccagccatagcgctggctgcaactggtccatttttaaaaagctctaattaaagcacgtccttgacatttgggaggtattcatccacaagcccagatgtgttctcacattctgagtattaggaatgtttacacaggctcctgacgtggtcctaaatcacatgaatctcatttctgtctagaagcaccatttcctgtgcatattctcataccccaacttggctgcctttttgatttttacgtatctatttatttcaattgtgtttaatcaggtaatgaagctctaaagaaacaggaaacatggagacagtggtatagaacaaggtgaaggattacatccttgcataaccttggtgaatacatatgttacattcagtgtatttcaactgtttcagactttgatcccttccatctttgttctagaccaaagatttttctattgtggagtatttcaagaagtcctgaaatgtttttctttctgttttgtgtttttttttttttttgagacagagtctcactctgtcacccaggcttgtgtgcgatggcgtgatctcggctcacctctgcctcccgggttcaagcaattctcctgcttcagcctcccgagtagctgggattacaggcgtgcaccactatgctcagctaattttttgtatttttagtagagatggggtttcatcatgttagccaggctagtctcaaactcctgacctcagacgatccacctgccttggcctctcaaagtgctgggattacaggtgtgagccaccgcaccgggccctgaaatgtttttcttccagaggccctgtgtgaggaattagggctcagggctgaaggcaggcagccagcatcaccacttcagctgtgggatcgtggacaagagtactaacctctctgagagtcttgtttctctcttgtaaaaagagggtaataacagtaactgactcataggattaaaggaaacgtgagaaatatgtaagcactcaataaatattagttattattatttaaataaaagctccatagcggagtcttataatttttaggagtaaaatcataactctcatgcaaatataatatgaacatgtgtcaaatattttatttaacttatcaattaatgagtgaaccagtgaaatgctataacttactcaaaggagaatcaaagaggatatgtatatatgattagattgattgaccaattgatcattagatatgcagatatctaccatcagggatgctaaaatgagttggcttaaaagatgtaaactggttgggtgcggtggctcacggctataatcccagcactttgggaggctgaggcgggtggatcacctgaggtcgggagtttgagaccagcctgaccaacatgaagaaaccccgtctctaccaaaacatacaaaattagctgggcgtggtggtgcatgcctgtactcccagctactcgggaggctgaggcatgagaatcacttgaacccaggaggcggaggttgcagtgagccgagattgtgccattgcactccagcctggacaagagcgaaactccgcctcaaaacaaaagatgcaaaattgctcaatatcattaggggaattatcaactgcatcatccccactggtcacaacttgcatttctctggacaacctggaaaattataagatatctcaaagacaatgaaaggcacagaaacctcatagagtcagataagctggaagaatgtgctagattgcctctactttttgttgaagacacccaggaatgttttaggcctatttcaaaccctttcacaatttttcctgatgcttgttcatttgatatgaggtcaaaggacaatacttaacgtgacccatatccctatagagttttatgatattgaggcccgcagtggccttatgaggagcaatctacaggctggtgagctgaggcttggtagacttggctcacatgagttcagaagtccacaaacctcccccagggcagctcatcctccctttcttttttcttttcttttctttttttttttttgagatggagtctcgctctgtcacccaggctggagtgcagtggtgtgatcttggctcactgcaacctctgcctcctgggttcaagtgattctcctgcctcagcctccctagtagctgggattacaggtgcctgccaccatgcctggctaatttttgtaattttagtagagatggtgtttcatcatgttggaccaagctggtctcgaactcctgacctcaggtgatcctcccgcctcgtcctcccaaagtgctgggattacaggcgtgagccaccacaccccgccagctcctgctccctttcatggtgggtggtgcaaagcaggattgctcttggcccctcaaggccaaactaatgaaactgtgctacgtgcaactgatgcagggcaggtgaactccagaattggggcttagcctggcagggttcttggctttgcccaggaaagaattcaagggcaagctaggggagccggtggtgttagacagcaacttttattgaagcggcagtgcacagcagcagcagacagactgctccttgtggagcagggctaccctataggcagtgtgcccagagcaccagctcagggcagttctgcatcatatgtgtgcccatctagttatatgcaaattaagggccagactatacagaaatttctagaaaaagggtggtaacttctgggttgtcaggtcattgccatggaaaggggtggtaacttccggtgttgtcatggtaacggtaaactgacacggcacactggtgggcgtgtcttatggaaagctgctttctctcagtccctgtttagctagtcttcaatttggtccagtgtccaagccctacctttggagttgagttccgccgcctacctcagaacatttgtagagccatttaaaaaggaaaactctctaatgtgaccctttgtagatccactttatgtctgataaggaaaggttggaattctttctgctgtgtaggcacaggttcagggccacacagcccttcccttctttgaacaccggattagtgcatcagggagccccggcgtggtggattcaggctcaaacactggaaacagtccagcaaaaccttgacctatagagagtgaagggcacagggccaggggaggggagctctttgcggacacagagtgacttctttctctaacctgccttttgggtttccttggcttttccttcctcctcctctcggatgaacttgtgagaatgaaggtgcatgtctgtggcccatgctgggtcctccaggcatggtgggctctgggagggccatggctgaggagcccaaggaagccaggcccgttgctttctcacctgaggattcgtctcagaaccatgacacagtcaaatgagaacagaaaccccactctaaggccgggggcagtggctcaggcctgtaatcccagcacttttttgggaggccaaggtgggtggatcacttgaggtcaggagttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattatttaggctgtgcaggatcggggtgtcaggtacttttcaggtctgaggtgaggccgtgggcagggcagcttctacccacctcatctcaactctcccttttcttgctcagtgtcacatataggaccagttacataatttgtgggtctagtgcaaatgaaaattcaaaattatcaggaatttcaaggtggcgacagcaaggcatcaaaccaagcatggcagcttctgagcacagggcccctgtgacggcacgggtcacacatctatgaagctggctctggtctcatgactcatgtgtgtcaggtcagggactgggtctgagccttctgcccagaaaggtgctgtaaaaggtcagtcacagaagccttgtagcaagccaggcagacacaggcaggcagatgtggtgctgggaacttggttgatgtttcacctcctggccctcagctccccatctgtaatatgggtcatgatacccctgtggtaggctgctgatgacccccaaggatatcaggccctgacccctggaacctgtgaatgttgccctatatggtgtcttagtttgtttggactgggtgccttagaaacaacaaaaatgggccgggccgcggtggctcacgcctgtaatcccagcactttgggaggctgaggcaggtggatcacctgaggttgggagttcaagatcagcttgaccaacacagagaaaccccatctctactaaaaacacaaaattagccaggcatggtggctcatgcctgtaatcccagttactcagctggctgaggcaggagaatcgcttgaacccgggaggcggaggtttcaatgagctgaaattgtgccattgcactccagcctgggcaacaagaatgagactccatctcaaaaaaaaaaaaaaaaaagaaacaacaaaaatgtatttctcacagttctggagtttgggaagtccagcatcaaagctccagcagctccagtgtctggtgaggcctacttcctcatttatagatggctgtctctctgctgtgtcctcacatgatggaaaggactagggaattcttttcttgccttttttttttttttttctgttttgagaaggagtcttgccctgtcacccgggctggagtgcagtggcgcggtctcggctgaccacaacctttgcctcctgggttcaagtgattctcgtgcctcagcctcccaagtaactgaggctacaggcgcgccaccatgccagctaatttttgtatttttagtagagataggattttgctacgttgtccaggctggtctcaaactcgtggcctcacgtcgatctgcccaccttggccacccaaagtgctgggattacaggcgtgagccaccgcaccgggcctagggatttttttatggtccctttcataagggcaccagtcccattcatgaggcctccaccctcatgacataaccacctccaaaggctccacctgcaagtactatcacactggggagttggttccaacatgtgaattgtcgcggggatgcaaacattcagtttgtaacatgtgggagaatgggatttgcagatgtgattaagttaacagttttgagttggggagattatctggatgggctccaaatgcaatcacaagtgactttaccagagaggcagagggaggcggggcacattggtttatgcctataatcccagcactttgagaggcccaggcaggagaatcccttgagctcaaaagttcaaggccaacctgggaaacatagcgagacctcatctttacaaataattaaaaaattatctaggcatggtggtgtgtgcctgtggtcccagctactcaggaggctgaggtgagagaatcactggtggtcaaggctgcagtgagtcgtgattgaaccactgcactccagccttggaaacagggtgagaccccatctcaaataaataaataaataataaataagggagattagacacacagaagagaggtgatgtgaagattgagcagagatttgaagatgctggccttgaagactggagtgatgcacccacagaccaaggaatgccagcagccaccaatctgctcctgtaagaggccaggaacagattctcctcccgcagagcctctgcagggagtgtagccctgctggcagcttgattttggtccattcatacttattctagatccagaatggggaaagaataagtttctgttgttttaagccaggaagtgtgtgggtatttgtcactgtagccacaggaaatgaaaacataccctctaaaatttttaaaataacagattcattgagatatagttcacatgccataccatttacctatttaaagcgtgcaattcaatggtgtttcatatattcagagttgtgcaaccatcaccccaatcaattttagaacattttcattatcccaaaaagaaacctgtattctttagctatcttgcctaatcccccagccctagccaaccaaactactttccatctccatggatttgcgtattctggacattgcatagaaatggaattatataatatgtggcctttcatgtgtagcttcttccacttagcatgtttttaaagttcatctatagtgtagcatgtatcagtatttcgttccttttgttgttgttgtttagagacagagtctcatgctatgacctgggccagagtgcagcggtgcaatcctagctcactgtagcctcaaagtcctgagctcaaacaagcctcccatctcagcctccagagtggctgggactaccggggcacaccaccacaccaggctaatttttaaaaattttttgagagaagttggtgggaggtgaaaaaaaaaattttttttttttggtagagccagggtctggctatgttgcccaggctagtctcaaactcctggctttaagcgattctccagcctcgggctcccaaagtgctgggattaccggtgtgagccaccatgccctgcccagtactttattctttttattgccaaataatattccattatatggctataacacattttgtttgctcattcatcagttgatgaacatttgtgttgtttctatattttggctattgtgaatactgcttctataaacatttgtgattttttttttttttgagacggagtcttgctctgttgccccaggctggagtgcagtggcgcgatctcggcttactgcaagctctgcctcccgggttcacaccattcttctgcctcagcctcccgagtagctgggactacaggtgcccaccaccacgcctggctaatttttttgtatttttagtagagacaggatttcaccgtgttagccaggatgacctcgatctcctcacctcatgatccacccgcctcggcctcccaaagtgctaggattacaggcgtgagccaccgtgcccagccctataaacatttgtgtgcatgtttttgtgtggacgtgttttcagctctcttgactatatccccaagggttgaattgctgctggatcacatggtaactctatttttaattttggggaaccaccaactgttttcaaagtggctgtatcattttacaatgccatagtagcatatgggcattcctgtttctctacatcctcatcaatatttgttgtctgtctttttggttatagttatcctagtgggtatgaagtggtatctcattgtagttttgatttgcaattccctaatgactaatgatgttgagcatcttttcatgtgcttggggtcattttttttttttatcttcttaggagaaataatctgctcaaatccttttttttttttttttttttttaagatggagtctcattcactctattgcccaggctggannnnnnnnnnnnnnnnnnnntctcattcactctattgcccaggctgggagtgcagtgacatgatctcagctcactgcaacctctgcctcctggggaacaagcgattctcctgcctcagcctcctgagctcctgagtatctgggattataggcatgtgccaccgcccggctaattttttgcatttttagctgagatggggtttcaccatattggcccagggctggtcttggaactcctgaccttgagtgatcctcctgcctcaggctccccaagtgctgggattacaggcgtgagccaccacgccctgcccctttgccaattctttaaaatggttgtgtttttgttgttgagttgtaacagttctttatatattcaagatcctagacccttatcagatatattatttccaaatattttctcccattctgtgaattacctttcactttcctaatgctatcctttgcaataaaaacatttttaattttaatacagtctagtttatctgtttttgttattttgttgcttgtgcttttgtggttttgagaacagaatgcacaaacacctgttttggcttcagtgcctgggacatggtggtgctcttcccaggccagcggccaggccactcagggtggaagacagtaggtcccttaaccccttgggctgttgtgtgcctgatctgttgtcaggcccttcttcattaggtttagaagatacagtcatcagaagaataaaaccactgtctaggtaaaagaaatttttaaatatataatatgaatatcttcttatttataccagtacagtttcaaaatgtaatttttttttttttgtggaggaagaggtctacaaaggcaaaaatgcctatggttatgagtcataatacaaccatgtcagccaggtgcggtggctcatgcctataatcccagcactttgggaggccgaggcgtgcaaatcgcttgagctcaggagttcaagaccagcctgggcaatgtgacgagaccccatctctacaaaaattaccaaaattagccggatgtggtggtgcatgcctacagtcccagctactcgagaggctgaggtgggaggatggcttgaacctgagaggcggaggttgcagtgagctgtgatcacaccgctgcactccagcatgtgcaacagaacaagaacctgtctcaaaaaaaaccccaaaaaatcccaaaaacaaaacaaccatgtcccttgtaactggagggggcctcctgcaggggatggaatagcacagactcctccacaatgtccctgcctgcctcccttttgcccagctgcccaactttgtgaggggccagaccggggtggtgagggcagcatatggtgggtgtggaagaaaaggcactgagcgctgccccttgggttcactaagtcagctgagctccagagcagcgattcagatgtggcaggcccagccaaaccagatcaacaactgttgttattattgttcaatcataactattgttttttttaaactttttaattaattattattactttttgagacaaggtcttgccctgttgcccaggttagagtacagtggtgtgatcgtggctcactgcagcctcaaactcctgggcttaagcattgctcccacctcagcttcacgagtagttgggaccacaggcatgcaccaccgtatgcagctattttttatatttttttgttgttactatgttcttactgtgctctgctggttaaatgtgctttcaaaggctagctcttgtttgatcttcctaacaagcctattcaatgggtagatgggcacattattcccattatataggtgaggaacatgagcctcagagcatttaagctattaagctgcagagaacagacagggaacccaggcttctgatttacgcattagtgcacgttcactcccaggctggggtgtgtcccaaacccagtggatgggggctgttgagtctggctcatcaactctccaagactaatgagatctgaggctacaggtgggggaaatggaacggccggtgaatctcatttccaatcaccattgtcatgaaataggtggttggcctgctgtgccctccgacatgtctgttgcccacctgcctccgccttcctccccccactccacctccagttgctcagaaaaaccacttcctgaagtttattccagcagacagctttttctgtgcagttaacgagtcgctatgtttcggatctgcgttacttccccggtatttgaaggcaggagcactgcaggtaggaataactgtgtgtctgtcctccttcaattctgcttggctgagaagaagcgaacaacaccatgggagaaacagggtcctgggtgagtttgttaagcctggtgggaactcctggggtcccttggttatgtaggagtcagtctcttgatcagttaccaagaagccaaagccgtgtgggaacctttgcctcaacccaatcaaggaatccaccaaggtcaaggggaagaagtgaggagaaaggagaggcccacaaacgaataaaaacccattcaatttactatattgaaaaaggccaggccaggcatagtggctcatgcctataatcccagcactttgggaggctgaggctggaggatcttctgagacaagaagctggattccagcctgggcaagaccctgtctctacaaaaagtaaaaaattagctgtgcgtggtggtgcacacctgtagtcccagctacttgggaggctgaggtgggaggattgcttgagctcaggagtttgaggctgccgtgagccatgattgtgccactgcactccagcctaggagacagagtgagaccctgtctcaaaaaaaagatgttggctgggtgcggtggttcatgcctgtaatctcagcactttgggaggttgaggtgggcggattgcttatggtcaggagtttgagaccagcctggccaacatggtgacatcccatctctactaaaaatacaaaaattagctgggcatggtggtgcacacctgtgatcccagctactcgggaggctgaggcaggagagttgcttgaacccaggaggcagaggttgcagcaagccaagattgcggcactgcactccagcctgggccacagagcaagaccctgtctcaaaaaaaaaaaaaaaaaaaaaaaaggccaggcgcggtggctcacgcctgtaatcccagcactttgggaggccgaggcgggcggatcacgaggtcaggagatcgagaccatcctggctaacacggtgaaaccctgtctctactaaaaatacaaaaaataagccaggcgtggtggcaggtgcctgtaatcccagctactccagaggctgaggcagagaattgcttgaacctgggaggtggaggttgcagtgagccgagattgtgccactgtgctccagcctgggcaacagagagagactctgtctcaaaaaaaaaaaaaaaaaagaaaaagaaaaaagacacaccaaagataatgataataataataaaaggtacatactgtatgaatctttacaaaattccagaacatggaaactaatcagaaagcagatcaatctttgcagtggggagggtgcagagggcaagggagacgaggggcataggaaccttttgggggtggtggatgtgtctgcttccttgattgtggaggttgtttcatcagtatacacatgtcaacacttttctgagtgtatactttaaacacagcttattttatgtcaattatataatacttcataaagctgaacagaaattcaatttcttaattaaaattttaaaggtaatactgccgggcacggtggctcccgcctgtaatcccagcagtttgggagaccaaggtgggtgggtggatcacccgaggtcaggagttcaagaccagtctggccaacacggtgaaaccccatctctactaaaaatacgaaaattagctgggcatggtggcacatgcctgtagtcccagctactcaggaggctgaggcaggagaatcacttgaaccctggaggtggaggttgcagtgagctgagatagtgccactgcacaacagcctgggcaacagcgcaagactccatctcaaaaaaaaaaagaaaaaagtgaaagggtaatacagtcacatgatttaaataacaaaagtacagaaagctttacaaagaaaagtccccaactgctcagtttctgccacccacccctctgccacagataataagaatcctttgcatccttactgactttctacaagttaatgtttaccctcccctactgattgtaaagtattctagtctactgtaaatagcaagtcaaacaaacgttaataaccttagagtgtgaggtaaaccctggacaggcatgcagtactcatttttgcctatttccaatttcagatactttttcttacattatggaaactatctgttcatattctttgcccatttttctattggattgttggtcttttctttttcttcttctcttttattttctttcttttaatcaggcagcctcccaagccagagtagcttagacagactcccgaactttttcttcttaatttatgagtgttcttcacacactagggaagttagctctttgtccgtgatgtgagttgcaaacattttttccagttagtagtttttctcttgactaattttttttttttttttttttggcaaaacagaacttttttttcataaagtacaatttatcaatcaattttatggcttctggattttaagttttagttaaaccagcctctgccattcaaggttgtaaggacttcttttcttcttttgtattttcttctagaactttttttttttttttttttttgcgagacagagtcttgctctgttgcccaggctgaagtgcagtggcatgatcttggctcattgcaacctctgcctcccaggttcaagtgattctcctgcctcagcttcccaagtagctgggactacaggcatgtgccaccacgcctagctaatttttgtattttttagtagagacagggtttcactatatgtgggccaggctggccttgaacccctgacctcaggtgatctgcccacctcggcctcccaaagtgctgggattacaagcatgagccactgtgcctggccccttctaggactcttatgggtttatttgtacattcatatcactggtccatttggaatgtattctggtacacagtgtgaattatgggatacaatttttcaattttctaaaaaaaacatttatttttgaaataaagctttattttatcatggtatcctgaaaatattagaatcatttatgaagcaattgccacattttagaaatttactttggaacttgagggcacggggtctggggtcttggcatttatcactatcatttgaattgttgctctgcaaaaggtgcttactctgcagtgtctaaaaattaccattgaagccaaaatttattttattaatcatggtgtttccttttctgttcccacatcaaaatttggtagatgggtgagggtaatttccagtaggttgccaaagaagatagcttatagtggggaatggcgagcacaaaacaacagcaaataacgcaatggaaaacattcctttagaaataaatgggtaaagtgtgtattgctgttcaaggctcttatcaaaacttccactgaaccataggtcagagagaggaattgttttctagctggaagccattacttcttggttcttgccctgaggtagaggaatctggttttgactgtggccagtttgtatctgtcttagctttaccatggggaagtcctagagggtggcatttcagaaacaatatggcaccctcaaggcagtgatcatctgattcagacaatacagtagtttgtcttcatccatctagacaatcatccattgcactaatgctttttcatcatctactaggttccagacactgtccctgtcatcaaggagattgcagtccatttgggggaggacaggccattatgacacatcctataataaaagtgtctggctgggcgcggtggctcacgcctgtaatcccagcactttgggaggctgaggtgggtggatcacaaggtcaggaggtcgagaccatcctggctaacacggtgaaacccgtctctactaaaaatacaaaaaattagccgggtgtggtggggggcgcctgtagtcccagctacttgggaggctgaggcaggagaatggcgtgaacccgggaggcagagcttgcagtgagccaggattgcgccactgcactccagcctgggcgacagagcgagactccatctcaaaaaaaaataaaagggtccgacagctgggcccggtggctcacacctgtaatcccagcactttgggaggccaaggtgggcgatcacctgaggtcaggagttcaagaccagcctggctaacatggtgaaaccccgtctctactaaaaatacaaaaattatccgggcatggtgacgcatgcctgtaattctagctacttgggaggctgaggtaggagaattgcctgaacccgtgaggtggaggttgcagtgagccaagatcacgccaccgcactctagcctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtaggtgcaaggtaaggaagtggtgagagactaggcttgaaaggtaagcaaaggctgtattatggcaggctgtaaattgactttttctggtctcaaacagaggagtgaaaggaaatgatgtatatcttttttttttttgagacagtgtttcactcttgtcccccaggttggagtgcaatggcgtgatctcagctcactgcaacctccacctcccaggttcaagcgattctcctacctcagtctcctgagtacctgggattacaggcatgcgccaccacacccgattaatttttgtatttttagtaaggacggagtttctccatgttggtcaggctggtctcgaactcctgacctcaggtgatccgcccgcctcggcctcccaaagtgctaggattacaggcatgagccaccacgcccagcagaaatgatgtatatcttaggaagctcccgcatagtggcccagtagagtacgcatttgtttaggggtgcatgctggggaggggcctctcatagggctgcgtatgtcacccacaccaaaagctgaggagagcttcctagttctgttaccagatggtgccgcgcagctccaggctgttggtgccatgaacaaagaattggacatgacacacgtacaaatagcgaagcagcaaatgattaagcacagcgacactctcggagaggggtgagtgggctgacctgtgagtggttatcagtgccggtttgttacatttcacggccttttacatgtttttcctcacttgcttaatgtcacttgcctttctcttatagtgccttcaccctactttatttcttgtaagatagttgttcaaccttgtttacccccactttacctcttctgaccaaattgcccatctttacttttattttttgcgaccaaatagctactggaagtccttccaacttacttctcttaccatgtcccaacttactgcttactcccttatctattatattactttttgtggcaatatttgattgatgttttaaattacagactataaagaaacaccataaaatattaagacagtctgagagattttgatgtgttattaatatccacatggtttgcttcttttccaaagcatcccataacgtttgactctatgactgtaacaagttagatttttagaaactgatgcaaaggatcagattctagtagtttctttctctttttttttttttttgagatggagtttcacttctgtcgcctaggctagagtgcagtggtgccatctcggctcactgcaacctccgccttctgagttcttctgcctcagcctcctaagtagctgggattacaggtgccggccttcatgcccggctaaggctaatttttgtatttttagtagagacgggtttctccctgttggccaggttggtcttcaactcctgacctcaagtcatcctcccgccttggcctcccaaagtgctgggattacaggcatgagccatcgcgctctgccagattctagtattttctaccatcaaaatatctattacccaatgaaaagtctaaaggccaatcttttttttttttttgagacaaagtcttgctctgtcaccccaggctggagtgcagtggttcgatctcggctcactgcaacctccgcctcccgggttcaagcgattctcctgcctcagcctcttgggtagctgggattataggcgtgtgccaccgtgcctggctaatttttgtatttttattggagacagggtttcaccatgttggccaggctggtctgaaactcctgacctcaggcaatcctcctacctcagcctctcaaagtgctgggattaccggcatgagccacgactcccggccccaaaggtcaatcttaaagctacaaggtatcttttaaaaggagtaggaataacgtattttgaggcttaaaggagtaggaatagtgtatttttagatttgaagccatcttctaaagggtacgatatttggttaacatgtcactccttatcgccatggaagaagttaattctattcttttttttttttttttgagatggagtctcactctgttgcccaggctggagtacaatggtgtgatctcagctcactgcaacctctgcctcctgggttcaagcaattctcctgcctcagcctcctgagtagctgggattacaggggttctccaccatgcctgtctaatttttgtatttttttttttagtagaggtggagtttcaccatgttggtcaggctggtctcaaacccctaacctcatgatccgcccgccttggcctcccaaagtgctgggattacaggcgtgagccaccatgcccagccgttaattctattcttactgcttactcccttattttgtatgttcttcttctatcttacatcttttgcttttgctattgcttaagctagcctacgcccaagggtgctctttgccccctacttcctctgctattctctcgcctcagttccgctgcattccaagctcagcctgccccagcagcaggtctctttgacaaacctgcaattttggggaaaagtcagcccaagaaaggcagggggcccagacttatgctgtgtggcaaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttggctggtctgaaagtagtgggttatcttgatgaattgtttagtcagttacagatcaaactccatgttcttttctctgttctcacgactactcttgactagtctaaaaatatattaggttgttgaaaagtaattgtggtttttgccattacttttttaaaagatggcaaaaaacacaattataagtagcacacattttcttttttttttccttttttttttgagacagagtctctgttacccaggctggagtgcagtggtgcaatcccggctctctgcaaactccgcctcctgggttcaagggattctcctgtctcagcctcctaagtagctggaattagaggcgcatgccaccaggcccggctaatttttgtatttttagtagagacagggtttcaccatgttggccaggctggtctcaaactcctgacctcaggtgatccgctggcctccacctcccaaagtgctgggattacaggtgtgagccaccacgcccggcctcacattttctagatttcagtgcattgctgttttttgggatggggaagtgatttttttattttaatgagcaattccataattagttttttgttgttttaccataatggcttatttgaatattgtaacctatccccaactgtttttatttgcaaatgagatataattgatttgttagacatatgaagacagatcctagtttaaattgttgctactttttttactcctaaatgataaaaatcacacactggagctcattttccattcacctgtgaggctacaagtatatctgtaatattttgtgcttgtacaaagggaagtggggtgctgcctatctttgaagcctggtttatcttccactttacagctaattttgaacctttgtcttgagatgagagggttttgttctgcttcttctgggaccacatgaatgagggggctcagtagtgtcccggggctgtgaatagagggagagcccacagaacactatttccttgtcagaagtcactgcaatcagcaaagaatggaggtgactgggttgcaggcaaattgcacagctctttggaggtgaagtccatgggcaaggctagctggtgagtcaagcctcggagcagtggccccaggctggggagggctagttggccactggcaaagcccctctgccaggcttctctgctcaactgtaggtgcttccttgggcatttgatccccatggcaacccacggaggcaggatatccataatcttcataattatcctgctggactgatggtgtcaccaagcctcagaaataaccgattttaccagccgtgttggctcacacctgtaatcccagcactttgggaggccaaggtggtcgaatcacttgaagccaggagttcaaaaccagcctggccaaaacagtgaaaccccgtctctactaaaaatacaaaaaattagctggacatggtggcacatgcctgtaatcccagctactcgggaggcaggggcatgagaattgcttgaacccgggaggcagaggttcggtgagccaggattgcgccactgcactccagcctgggcaacggagcaggactttgtctcagaaaaaaagaaagaaagaaagaaagaaccgatttgtccacgagagaggcagttggctgggcactgggactggaacttccactctctgaagctgcaccatttgtctggagccataggcctgactcaagtcttttagaccagttttacttaagctctttgatttgttttcccaatctgtaacatggggatgataagagaacttcgtgggcatgaagtgggtgtgaggttgagactggataaaaggaggtgattaattggcccccgcctcgaggtgattgataaatgacaatggtgtttactacacggtcctagcccccctttacgactgtgactcctgccctacccactctccctttgtccactccagccctcgtaccctcccagaccacaccctttgggccagaccctgccctgcagacactcacgctttggggtccctctttttcttacccacaacatcctgtttcccaaaaccgtggtgctctcccctctccccctccacaccacatggaagtcaattgctccctcctttgggttcctagagaatgaatgttctttgtaccttcagggaagacgttggaactgcagcacatggcacagggagcgactctcccactgcctcctcaggcctctgccttgttttacactcaaggaaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttccttccatctcaggcctctttgttcccctccagcccgcacctcactgcagctgcctcacctcaggaggtgacggctgctccgtcttcacctagaaaacagtcatctggagggaactccctcaacttcccgcctgggcctggctgcaggcttatcagcctctccacccatcctctcggtttccctcccggcctcggaggacacatgcaccctgctcctcagctgatgggggccagccaggcacttaggctgagacccttcctcacccccaggaccccacgcctacgtgcattcaagtccctctcccctaccaccacttctagaatctctatttctgcttctggctctgttctctcagtgaatgggaactcttttttttaggaaaaagaaaaatcacaagcagacacccacccccaccgtttatctggtgtccccctatctggcctttctagtttcctttctcagtcgaacctctctgaaagttagtttataatctgtgcctacccccctcacctctcagacacgcctcgcctcccagcagcctggcctcaggccccacttctccggctgttgggtctcctcttgctgaggggtcaccaaggaccacctgatgccaaatgcaacggacacttccagccctcggctccctgtacccctttcctgcctttgacttttgatcgtgccccaaagcctcgctccttgaccttttccatcctcttccctgctttgtctcctcactctctaacaaaccctcttccttctcccccatggctgactttggacttactttgtcttctcctggagtctgaaccctgtcctggtctctgcgggctcctggtcttatcctccctggagaccagctcccctctcaacacctccacattcccccctcctcccctaagttcacactcctcccaccttcacagtccagccctggcctctgccctgagcctccagttaacacaggctgacctttgatgtctcctcccagtcctcctactggcccctcacacgcagctgcaccaccatcactttgtcttccttccttatctttttctgtttgtttgtttgtttttgtagagactggggtctcattttgttgcccaggctggtctcaaactcctgggctgaagccatcctcctgcctcggcctccgaaagtgctgggataacagatatgagccaccacacacagctgcgtgtggcattttctattttagtttggtggcacacacatcctcctgggaatctaatccaggaagtttatcttccattctttcaaccccatatccaatcaaacaaagtctttttttaaattgtggtaaaatacaaataatataacatttattattaatgacatttagtacattcacggtgttgtgcaaccatcaccattgtctaattctagaacattttctttctttttctttttttttttttttttgacagagtctcactcttgttgcccaggctggagtgcagtggttggatctcagctcactgcaaccttcacctcccagattcaagcaattctcctgcctcaccctcctgagtagctgcaattacaggcacgaaccaccatgcccggctaatttttgtatttttagtagagacaaggttttgccatgttggccaggctattctcaaactcctgaccttaagtgatccacctgtcttggcctcccgaagtgctgggattcattctagaacattttcaacaccccagaaacaagtcctgttgagtccactcaggagatccccagcctatccttccctcatccccactgcacccgcctagctcaggcctcatcagctttcacctgaaccacttccaagctgtttactggccttgggtgctgtcacacccctcctgacaccctcaggacagggcccagcttgtcagcacagcaggccagccctccattctggcacgacagacccagccacctggcctctctagccccacactctggtttctgtaatgggccatgcccagaaggcacggatttctcacaccctcgtgtcctgggacacgctgttctcttacctggagcaccccactgcctgtccttggcctggcaggctcagttcagtggtcacttccttcagactccttgacctctcctgggcagcccttcctcttggtgcttactgatatcactggagtccagctatgtgggccccagcaacctttgctgtttgggacagcaaggatgatttcttacttactctgtcagcccagcacctggcacaggttctcgacacatgtctcatggatgggaacttgaactgaacttggagatgcttgagattcgggtaggaagatggctcagcatgctctctgatgagcacagaagttcatcagggactctatgcttcgtggctcccagtaattttcctgacgagggtgggcagcccctccttctcctgcaccctccactttctctctgagtcatttccaggttgagggccagggggctggctgactcatggtgccgcatgtttccagggagcaccaccatccactgatgagtggccttgaggtcaaggtcccactgtttttagcatgttggggtttggcactgtggtcactggctgttccgtggtgactttccaaatttagatccttctccgtcaaccttcatctccccgggttgaaaagatctgacctctttaggctgtcccacagccccacccttcatcacaatagtcctgaaactttttgggttcagtaaggaaatctgtgggccttctctccagaaaaagcacacatttgcacacaattggaggtagttgatgagcctcctaacacccacccatgcacctcccaggggctgtgtcccccaggttgtgaacagtcactctgtgtaaatagtgagacctacaggcagtaattcagtttggctgtgcttggctggtttatttagaaagatgataatgttttccatattatcaaaacaagaatcaggcagagacttttgaagtttggttgcgtggtatatttgttacctattgctgcttaacaatttacctaaaacttactggcttaagataacacagatttattatcctgaagtttctgagggtcaggaatgcaggagtggctgagttgggtggtgctggcaccgggtctcattagattgcagataaattgttggtcagggttgcggttatctgaaggcttgactgagtctggggaatctgcttccaagctcactcctgtggctatgggctggaggccttagttcctcatcctgggtaccttccacagggctgcttatgctatgactgctggcattccccagaatgagggatcccagacaggagagagagtgatcaggataaaagctgcattgtcttttattacctgatggagtattttgttggttaatgttaacgtgggaggtgaccacgtgtaagtgtgatgagcagagggcaaggaccattggggggggcatcttgaagggcttctatagcaagggaggtggtggtggttgtggcggtaaaaactaggtcactgtttttgttgttttgtcgatgatatttgtgttaagatgaagagctgagactcatatctcaacagagtttataaaatgcttttcttttttccatcctgccctctcttctcccttgtctgttcgagctagccatgggaatgtggtgttcctgccagtgcatccattgagttcgtttattgttaatttatttattttctgagatggagtttttgctctattgctcaggctggagtgcaatgatgtgatcttggctcactgcaacctctacctcctggattcaagtgattctcctgcctcagcctcctgagtagctgggatgacaagtgcccgctaccatgcccggctaatttttgtatttttagtaaaggctaggtttcaccatgttggccagcgggtctcgaactcttgacctcaggtgatccaccgacctaggcctcccaaagagctgggattacaggtgtgagccgccacaccctgccgagtttgtttatttgagcagataatgtgtgttagagttgcttagaaaaacaagatggtggacgggccccatgctagtgggtaccatccctactggaaaaaccactgcttggtgcattagccaaatttgctttaaaattgttttttaaaaagggagggcttttataaaaatcaaatgaactaggactggttagtgggaggctcacgcaagggttgtgctgaggctggaaggcccagagtaggaagagttgtggagtgcagaatgagctctccaagggcagacactgccagcctcactgttctctgaacccccagtatgggggacagtgcttggcacagaaaaacccccttaaatgtttgctatgaatggtgctaaggaagaaggcagagaatgtcaaccagaggccaggcactgggcaatatatacacggccccttctgtgccctcagccactttggcgcagtcactgtttaggttaaagataccagagaaggcaggtattcatgttcctacttcgtaggcagagacgtggtggcccagagaggttaaataactcccgagatcacccagctaagcactgtgggatcacgggtttgaatctggtatgtctgactcccttctgtacccagcactgtctgctggtctagggcataaccagccagggatgggcagctcgttcagtaaacaggagagcagatgaatgactcgtgtggagagcacgcagtggagtgagcaaaactgggaggctggagaagtcgctttaaattaacctgaaaatgtttaatatgctttttattttgtttattttttttgagatggagtctatctttgttgcccaggctggagtgcagtggtgcaatctcggctcactgcaatatccacctcccaggttcaagtgattcttctgcctcagcctcccgagtagatgggattacaggcaactgccaccacgcctggctagtttttgtatctttaatagagatggggtttcaccatgttagccaggaggctggtctcgaactcctgacctcaagtgatctgcccagctcagcctcccaaagttctgggattacaggcatgagccaccacgcccagccttaaatatggtttttatttgaaaaaaaaaaaaatccctagaaacatgtagtggagacacagctttaaagctctgaatagttgattttcagctcatgcctgtaatcccagcacttggggaggctgaggcgggatgattgcttgaggccaggcgtttaagaatagcctggacaacatagtaagaccccatctctaaaaaattaaaattaaaaaataaaaaaagagtcgactttatttctgtaactggaagaatctagctaacatttctcaagcactttataggtgccaggaactctactttaagtaattaaactcaggttctcatttatacttacattccttgtgcctattgtatggataagcaaactgaggctcagagaaatttagggacttgccaaaggtcacacagctttgttagtagcagagatgagatttggcccaggtctggctccgtgcacttgatttctgctctttagtatctcctggttgagtcactggaatacacagcatagcttaaaatgaaggaggaagtactgaagaggtaatggaaggagacctaactgtctctgagagggaagagagtggttgggagggaactatattaattgaggagtgcagagaaattaatatggtccaaaggaaaaaaaggtttttttgagatggagttttgctcttatttcccaggctggagtgcaatggcatgaccttggctcactgcaacctctgcctcccaggttcaagcagttctcctgcctcagtctcccaagtagctgggattacaggcgcccaccaccacacccggctaattttgtatttttagtagagatgaggtttcaccatgttggccaggctggtcttgaactcctgacctcaagtgatccacccgcctcggcctcccaaagtgctgggattacaggcataaaccaccgtgcccggctggtccaaagaaagttgtgtgtcgagagctcatccagcaggcttcttaaatcaggagcttgtaagttgcatataaagacaaaaaagggagttccaaagagtaatgctgtgggaaatgacttgaatttaaaccgtcaccttgtttcatctcatggactggtcagacaccatttttgttgtcgttgttgttgttaaattaattgctcagaatatagcagcaggcgcaaattgtagtactcgttttaaaattgaagattaaattttaaattacccaacaaaggcctaactttgttaaaagagagggaaaggacaggttctgccagtatctctggccagctagctaactaacttttttcttattccaaaaaaatgacttgggaccacttataaaaattatgtattgttcaatgagatacaattaatgaggaaatcaggatgagagaaaaataaaggcagggaaataaagctatggcccatttagcacaaacgcatcccaaagattgctagaagcagaggtgaaatttttgctgtgtgttaacaatcaaagcaaaaagaggaacaaggtccattagaacattctcagaatccacaagatagaaatgaatcagttgttcagcataaacacagtgtttcctggtgctgttggaacactttgtgaaattagggacaatatctcatcaacatcccagaccaacatcccaaaagaccatttaatagcttgcatctgtgcttctccctaccccatagcccctccctccagagatgaccactatgctgacttgtaaaatattaatcttatatccagccacctttctttttcgtttgtttgtttgtgtttttgcagacagagtcttattctgtcgcccagtgcagtgttgtgatctcaacttactgcaacctgtgcctcccaggttcaagtgattcccctgcctcagcctcccaagtagctgggattacaggtgcatgccacaatgcctggctaatttttgtatttttggtagagacggggtttcaccatgttagccaggctgatctcgaactcctggcctcccacagtgctgggattacaggtgtgagctgccattcctggccttatccagccacctttctaaactcacatttatttctaataatttgtctgcagactctttgaggtttttacatatcatgtcatctgtctttgagagttttaaacattggactgctccattcactcaaaaattttaaaaaattccatgattgcattattcatacttcatggagatagatggggggctaagaaagcataccagacatagtcactttcaatcccaggtccaaatgctggataggtagcttccttgagaatgggcatggtagaaatttctggggggacgtgtagggatttgggaaaaacacctggttttatggtcatggactttcagtacatttttttccaaatcccctacagatcaattactttttctcttttttatacttatttaattttttttagatggagtttcgctcttgttgcccaggctggagtgcaatggcgcgatctcagctcactgcaacctctgcatcccgggctcaagcgattctcctgcctcagcctactaagtagctgggattacaggcatgtaccacacccggctaattttgtatttttagtagagacagggtttcaccatgttggtcaggctggtcttaaactcctgacctcaggtgattcacccaccttggcctctcaaagtgctgggattacagccgtgagccactgcgcctggcctcttttctttcttttttttttttttgagacaggatctcactctgtcacctaggctggagtgcactggcatgatcatggctcacttcagcctcgacctcccaggctcaggtgatcctcccacctcagcctcctgagtagctgggactacagacacatgccatcatgcccagctgattcttttgtatttttgtagagtcagggttttgccatgttgcccaggctggtctcgaacttctgggctcaagcgatcctcctgcctcggcctcccaaaattctgggattacaggtgtgagccactgcacctagcttcatccatattttttttagccatgtatagaacatgagatgtttgaagttgttttctgacaggaatttggagagtgaatattttatggtgctgattaaacccagattcatgtgcttggaaaagacaaccacagggaagctagtgagtgctttgagatatgtcaaggggtaaaactaagaccacaagtgggctgcagaagcacctacaggcattgccaagaggatctccaaaaagcagttcaccctggtctgctctgaagtttggatacaagtcctgacccatgggcatggttcaggatcttctagcctggaaaattttcagggcagttgcccacaaccaaccaactgacaaaaacacagcaatagctagagagcacccaattttaagcaatccacccttccgtcagcctgctactgtgaatgagcctcaatatgtgatctgtagttagctgaattctattgacagcctatggttactggatataagccaattctgttctggggacttgccagaaatgacacaattggccagttgacccacagcctagttcctagcagagattggatagctgattgagcattgtggctgttttgaggcttgaccagagattcctgccgttggcagaggggaatctgtagtctttgcttcttggtagcaggtgaggctgaaaacgcaagtagcaggctaaaaactggtttcaagtcctcaccatctggtgaaacctcagagcccatcagatagaaaatgccagctgggactgtgctaattcggtaaggcctgggtggagaaggagggcctgggcacgaccatctggtttcggaatggaggtagcagtcatttattaagcacttaatgtatatcgggcactgtacaggagacgttctggctgttctcctgtacatttcctgcaaagacctaatgagatatgattactccatcctacaggtaaggaaactgagctcagagagtctagctgcccagggtcacacagtaaatgatgagccaggacttgaacacttgactgcttgaatcctgtactccctccaggggccaagatgtggcagctcacagaatgcctatatctttttttttttttgtcttttgagacagtctcactctgtcgcccaggctggagtgcagtggtgagatctcacctcactgcaacccccgcctcccaggttcaagtgattcttgtgcctcagcctctcaagtagctgggattacaggcctgcaccaccaaacctggctaatttttgtatttttagtagagagggggtttcaccatgttggccaggccagtctctaactgctgacctcaggtgatccacccaccttggtctcccaaagtgctgggattataggcgtgagccaccatacctagctctacatctttatcacactctgttcctttgccttggtgggaaaagttgcagcttagtaccaactgcctcctgcttgagccactgtgcacagttactatcagcctggccctgtaggcacgtagaacccctggactcaatactgcataggatgggataagaccacatctgatgtggtgaaggtcaccgggatgatgttgtttctgagataacaggtatgtctgccttccttccctttgcatttagctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggtgagtccttggaactgagcacaggcaagcagatggagcatagcacacagtggcgtgaataacagctgtgaatgaatagtgacactggacttaactctccacccatcaccctctcattcatctgcctggcattttccttacctgaatacgtaagcactagacatattcccaataggccaggcccttccttccttccttccttcctttctttctttgatggagtctcactctgtcacccagtctggagtgcagtggtgtgatctcggctcactgcaacctctgcctcccaggttcaagcgattctcctgcctcagcctcccaagtaattgggattacaggtgtgtgccaccacacctggctaattttgtatttttagtagagatggggtttcactgtgttggtcaggctggtctcgaactcctgacctcaagtgatccacctgccttggcctcccaaaatgcttcttcatctcgtctcataaattaaaatttcttcttcaagactcaactcaatgatgtcttctctttccaaaacaaaatgggtctaccccagggtgccagtcagtacagctctgatgctctctctacattcaatggtatttgtgtgtataaaggccacagcggtgtgttaagacacctcgttctgcagtcactctgcctgggtttcaatctgggcaagtcccttaacagctctaaacttcaaaatcctcaccagtaaaaggaagataacaacgatacccatttcaggcaattattgagagggttaaaagtgtcatgtgggtagagtgcttagcaaaatttccagcacctagtgagttcctaataaatagaaatgtatttatttattttgagacagagtcttcctctgtcacccaggctaaagagcaatggcgcgaccttggctcactgcaacctctgtctcctgggttcaagcgattctcctgtctcagcctcccaagcaactgggattacaggcacgcgccactgtgcctggctaattttttgtatttttagtaaggatggggttttaccatgttggccagcctggtctcgaactcctaacttcaagtgatttacccaccttggcctcccagagtgtcaggattacaggtgtgagccaccatgcccggtccacaaatattctatttcactcagtattgccatccgttcttacacatctgtctgctcttctggatagtgaaattgtaaagacagagatggtgtttggtttattcttatatcttgaacaatgaatctggctcatagtaggcattcagtcaatgttcatggaataaattaaagtcagtcctagcctgtggctgcattcaataaagggtaacaacaatcacagtgacactgacaaatactggctacctttcccctctaagcatcatctgttgggaatctgattgtgtcctcttcccaataggattataaatcattgaaaacaccaagtacatcttgaccatattttattttttaaatttatttatttatttatttatttatttttagacagagtctcactctgttgcccaggctggagggcagtggcacgatctcagctcactgcaacctctgccttcggggttcaagcaattctcctgcctcagcctcccaagtagctgggattacaggtgcctgccaccatgcccggctaattttttgtatttttaatagagatggggtttcgccatgttggccaggctggtctcaaactcctgacctcaggtgatccacctgcctcagcctcccaaagtgttgagattacagatgtgagccacctcgcgtggccttagtggtgattttggtggacccatcacccgagcagtgtacactgtacccagtgtgtagtcttttatccctcgctccctcccactctttcccctgagtccccaaagtccactgtatcattcttatgcctttgtttcctcatagcttagctcccattgagcatattttatattttttcctttcttttcttctcttttttgagacagggtctctgttgcccaggctggagtgcagtggtgggatcactgctcactgccgcctcaacctcctaggctcaagtgattctcccacctcggcctcccaagtagctgggactaccagtgcacaccactaactacccctggctaatttttaatttttttttttgtagagatagcatttcaccgtgttgcccaggctggtctccaactcctgggctcaagagatccacccacctcagcctccagattttatatatttcaaagtgcctagtactgtgctgggcacatacctgttcatttattacctggtaggtcgcactgggtgttcagagaacaaaaaagagccctctcatgggtcaactacagtcactcagcggagggaggcttgtgtctctcaatcaggctgatactgacagactttctcttcaatcaggctgatactgacagactttctctttccccgtaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatcctgctcccttcctcatcgttctttgtggtttctggtttggtatggggagaaagaacccagaactgggaaggggctgctgttctcaggacttaagacctgttcttaatcattttaagccagtatttttcaagcttttttgactgttatacagttaaattgcatacaatttttcagacaagagtttcaccaacaacactttactcttaatatatatgatgctttttgtttgtttggcttggtttttggggtttttttttttgagacagagtctcgctctgtcgcccaagctggagtgcagtggtgcaatcttggctcagtgcagcctctgcctcccgggttcaagcaattcttatgcctcagcctctggagtagctgggattacaggcatgcagcaccacacctgactaatttttgtatctttagtagagatggggtttcgtcatgttggccaggctggtctcaaactcctgatgtcaggcgatccacccgccttggcctcccaaagtgctgggattacaggcgtgagccaccaccccaaccttgtgtgtgtttttgagacagggtcttgctctgttgcctgagctggagtgcagtggcatgatttcagctcactgcaacctccgcctcccaggttcaagcgattctcctgcctcagcctcctgggtagctgggattacaggggcatgccaccatgcctggctaaatttgtatttttagtatagacagggttttaccatgttggccaggctggtctcaaactcctaacctcagatgatctacccacctcggcctcctaaagtgctaggattacaggcgtgagccaccgtgcccagcctatttcagtctttaaacactggccatgacacactacactgatgcattatgtgatctgtagtttggaagccactgctttaagccatcgagggtcagacaccaggaagttgggtttggaggggatcgggaggaaagaggggccaggtcctcagccttggcctcctgttgttcaacgtagatttgcgttggacaaacagcaaacaaatgaggtggcctgggaaatgctcccaggagagaaggaggcaacagcagagggaagctggggagtgtccaggacatacagggctctaggacaggtagtcagccactcccaggacccggtctcatttgccaagccgggagaagtcaggggaaggcacacccatgtagatatttgcaaatatttccaaaataggaaacttacattttgtcataaatggtccccttcttttggcatcccactttatcctgcccattgtgtgtatgtgtgtctgtatgttctattatctgattataaaatcatgtgtgctctgggtagaattttcagacaaaagagcaggatataaagtatgtatataaagtgacaatcatttataatgcctctacttagagaaaaccacacatgatcctctagactttttctacatatatttatatatcatatacacacccagccacacacacacacacacacacacacagaaaaaacatcttttgtttttacaaaagatggggacctatcacactattttacagctttttaaaaaccagacaaaatcttatggacttttgtccatatgaagaaatatagatctatctcattttagaactcagaacttgactgtagggatgggccatctctgcaaccctcaaactcctgggcttgagtgatttacctcatcttctgctgatggatatttaggtatttttctcagtgtttgctattacaacaatcctgcagtatagatatttgtacttgtaacttgtgtactttggcaactattttactattattatttatgtggttaattcttagtagtcaaattgttgaatcagatgttttgtgcattttctttttttttatttatttatttatttatttatttatttatttatttatttgagacagagtttcactcttgttgcccaggctcgagtacagtggcgcaatctcagctcaccgcaacctccgcctcccgggttcaagcgattctcctgcctcagcctcccgagtagttgggattaggcatgtgccaccacgcctggctaattttgtatttttagttgagatggggtttctccatgttggtcaggctggtcttgactcccgatctcaggtgatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggctggacctggtggctcacacctgtaatcccaacaatttggcaggccaaggtgggtggatcacctgaggtcaggagtttgaggccagcctggccaacatggtgaaaccccctctctactaaaaatacaaaagttagccgggtgtggtggcacatgcctgtaatcccagctactcgggaggctgaggcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtgggaggatcacttgagtccaggagttcaagaccagcctgagcacatagtgagaccctgtctctacaaaaaataaagaattagccaggtgtggtgtgcacctatagtcccagctactcgggaggctgaggtaggaggattgcttgattctgggaggttgtagtgagctgtcatcgcaccagtgcactccagcctgggtaatagagtgagaccctgtctcaaatacacacacacacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgttttccttgaatttctgtcattctctgttttgcttattgtacttctctttccctttcccttctcaccacacacacacacacacacacacacacacacacacacacacacagcctgtcagtctcataggtgtcctataaaggtaaataaggcaggcaggcatttgaaattacagcagggatagaaagcaaagctcaggctttggaggaggaacctcttgtgctggatgctttgcttttaccttcagtgccttttggattgtttctccctctgttctagaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgataggtaagttgctgtgctgtgagaagaaatcatgtgggcttggggcattctttcacccccagggactgtggggacaataagagaagtagggggccaggtgcggtggctcatgcctgtaatcccagcactttaggaggccaaggccggtgaatcattgaggccaggagttcaagaccagcctggccaacatggtgaaaccccatctctactaaaaatacaaaaattagctgggcatggtggcgtgcgcctataatcccagccactcgggaggctgaggcaggagaattgcttgaacccaggaagcagaggttgcactgagccaagttgcgccattgcactccagcctgagcaacaagagcgaaactccatctaaaaaaaaaaaagcgagagaagtagtgggtgcttatgcaaagtccatatactagatatgcaccaaagcagggccaaggttcagtaaaggaggctggaaaatatttgggggctattgatgaggacaatgtaatctctttccagaacctttcaacaaactgctaaaatatgataagcatgaaagtgtcctgactgcaggaagcactgaagttgtgcatatgggctcccttagcactttctccttttcagatacactgttctgagaattgtagatcaggactctgctgttgtgactcctagccgggcaaccctgccttgtgtgaattctgcagcagtgagagctacaggctgtggtctcatggcagttactaacatttgcctgggattctcatcatactcaagagaaatataccattgtcttgggggtggacagtttcccttaagcctctatctcatgcctctcagaaggcctcaggagtgccattgcttgcatgtcttagatattttgcatcctgttgtaaaaagtttaataaggcttcctcctctttgtccttcttgtttagtaactgcctatctacatgggctgctggtggatgtgaataggagagagggattcctgcttctattcatgtatagtctaatagtagccataccttttcaattaacattaacataggctggttgaggtagctcacacctgtaatcctagcgctttgggaagctgaggtgggcggatcacctgaggtcaggaattcgagaccagcctggccaacatggtgaaatcctgtctctaataaaaatacaaaaaattagctgggtgtggtggtgggcacctttaatgccagctactcgggaggctgaggcacaagaatcatttgaacctgggaggcagaggctgcagtgagccaatatcattccgctacactccagcctgggcaacggagcaagactccatctcaaaaaaaaaaaaaattaacattaacatagactaagcacctaatggtgtgaggcatacaaaaaagaagacatattctttgtttcaatgctgtggtaagaaacacaagctctcctaattaaatgatggagaaacatctgaatcataataccaataagcatagaaaaaatgttaggggtcatgtttggttgtcacgtgaactatatccttacagtgatggtgatagtaatttagggtatgccagacttcatctagcttaagtgggtaaacattgtgaaaaagctgggctaggtgccagggcttgagaatgggtgggcagagaaggctgaagatggctgaacatctccagcaaacacatgagccaaaaggtcccatggggcacttcaaaagactgtgcgcagccaggtgcggtggctcacgcctataatcccagcactttgggagaccgaatggggtggatcacttgagcccaggagtttgagactagcttggccaacatggcaaaaccccgtctctactaaaaatacaaaaattagcccagcgtggtggtgggtgcctgtagccccagctactcaggtggctgaggtgggagaatcacttgaatccaggaggcagaggttgcagtgagccaagatcgtgccactgcactccagcctgggtgacagagtgagactctatctcaaaaaaaaaaaaaaaaaaaaaaaaaaaagactgtggccaaatcagatggctggaaacaaaggctggagtttgggaatggagaatcaccggatatgagctgaaaaagtggctgagcctaagcgtgacaggtgtcaggtgccagtctcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtggctcacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggcccggagcttggcttcttccattgtcttaccacagcctgcactcacaggagagtgactcataagttacaataccatctgctgaccatctgctctcacactagaaggaaagtctacttgggaagacaatttaggatccgaattttggtagttgaggatggagctaggaaaagcggatacaggaggtagccaagttctgcttggacctgcagggagtgaggctggccgggctccaggtggaaatgcccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgcaaaatgttcatacttccggggaaaacaaagaataaccagtgaataagaaaggggtgccaggtaagaagggaagagaatcagagtcatgaggaagcccagaagcccagaaaaagctgagttccacagtaagacctgggcaacagtgaagtatggagagcccaagattgggagcgtggaggaagagcatccaccactgaatttaatcagcaggggactcagggacgttggttggggaatcaagtgaccttcccagtttcttcaaaacttgagagagagtgcagtgtcacaagattgtgactacaaaagagtgcagtcagatttcaggggtaacaagaaagtgtgaaataagggagtcaaagcataaaggaaaaaggagaaaaaatggccgatagctagagaaggcagtgggtcaagattgtctgtggcctggcatggtggcttatgcctgtaatcccagcattttggaaggccgaggtgggcaaatcacctgaggtcaggaattcaagaccagcctggccaacagggcaaaaccccgtctctaaaacaacaacaacaacaaaaaaatccaaagagttagctgggcctggtgggcgcacctgtcattccagctactcgggaggctgaggcaggagatttgcttgaacccaggaggcacacgttgcggtaagctgagattataccactgcactccagcctgggtgataagagcgggactctgtctcagaggaaaaaaaaaaaagttgagcagtggctgtctcatgttcctcttcctctgcccttctttgctcagtgtgaatccttttcctgcttttcagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagaggtgagtcagggtctccatagcaagctgtgctgtgggctcccaagggcaagaccagaaaacacaccccttgtaagagggagttgggggggagtctagcttatgtgactgaaggctaggagagtaatgtcctccaggctcttggttgcaagtgacagaaacccactcaaattaagtaaaaaagagaaatcgattattataaggaattgggagaatgtcacatcgttccaattacaaattgttggcagactcaccattgagtcatcttgggtcaaacatccaaccacagaccacctgtagccaaggggattgggtcacgcagaacagacatgattggggaacccacttatgtgggtgggggcggtttcctggagaggaagagggctgaaaacacatgccaaaaaggagtctactccacttgagccctggagttggagaccagcctgggcaacatggtgaaaccctgtctctacaaaaagtacaaaaataggctgggcgcagtggctcatacctgtaatcccagctactcgggaggctgagacatgagaatcacttgaacccaggaggtagaggttgcagtgagcagagcttgctccactgcactccagcctgggcaacagagcaagactctgcctcaaaaatcaaaccaacaaaaaatagctgtgtgtggtggtgtgctcctgtagtcccagctactcgggaggctgaggtggaaggattgctcaagcccaggaagttgaggctgcagtgagctgtcatcagcctctagcctgggtgacagagtgagaccctgtttcaaaaaagaaagaaaaagaaaagagtctaccccagcaaagctggtttgttccctccttgaggaccacagctgacctctatttgtagcagaaacaatcatttctgcaccagctctgagtgcagaacccctcagaggtagatggatgctaaggcaagctgccagttacaagagctgtgagaatcagactgacttttgttgcttaagcctgatattatttcttcctggcagaggaagagcctatatacaaaaaaaattttttgttttgttttgttttcagtcattcttgccccatggaagaaaggacttattgcagtggttatcatcggagtgatcattgctctcttgatcattgcggccaaatgttattttctgaggaaagccaagggtgagcatagttctttccttccatactgactggtcgtccttgccaggaaaccagccagggatgcgtggtgcttttctgacccctggattcagctaggcaaaaatgaaagctattattttcctcattgggcaaaccagaaaagataaatttggggggaaattacatctttgtgtggttagaagaagccatttctgtagatttgtccacacctagtcctgtaatgcgtgtagagtggggtgcaagcgtcttggagacacacaaacatgcgcataacacccacatgttgcacacacacattgaatgctttgtaattaacctggtggttgtgctgtgacttctaccctatgcttggggttagctaagtaagcccggctgagcagccaggaccacctgctgataaccaggaatcagagtcagctgtccaagactcaaggaaaagggcagagcatcagtaaatcctgcaaaaatttttttgtgggataaggtaggttcttttggagcctctggtgctgctgcccaggatgggaggggaagatggggtgaggaggggccctggtttttgtcaggaaagctgccacccatcaaggaagatagagcacaccctggcgttgatcttaggccagcttcgagttacaaacgcagggattgatttcgcctttactttttgtaattatctggaatcaaagagagtggtcaggcacggtggctcacacctgtaattccagcactttgggaggccaaggcaggcagatcacttgaggtcaggagttcaagactagccgggacaacatggtgaaacccccatctctactaaaaatacaaaaaattggccagacgtggtgatgggtgcctgtaattgcagctactcaggaggctgaggcaggagaatcacttgaacctgggaggcagaggttacagtgagcccagatcacatcactgcactccagcctgggcaacagagcaagactctgtctcaaaaaaaaaaaaaaaagagagagagaggaagagagctgcctgcttatctggctaatctggttcccatatcattgtctctttttccatcatatttcactaacaaaaatcacttctggctaaaatagtcaagatatcatgtttctggggaaatatcttggtataagaccaagagaatacctctttcttttctgtcttttgtaaaagagtgaatatatttggcttctttttctctctttttctgggtattcaatcttctgggaagtcaaacgtagctgaaaagagtgttccttcacagcttactaggagtaaaacaaaaagaaaagaaaagtgttttctatctattaggttagtgcaaaagccattggcgttttggccattatagtggtatggatgtgggtactgtatactgactttggtttttcgttttctgttttaaagccaagcagatgccagtggaaatgtccaggtgagtgtatttgtaagaagggggcggctgctctgtgagcacggtggacatgtctggagggagattctggtcattaggaagttttcagtggctcttggcaaacttagaaaaatataggccttccttgagtgtgagttgtgtgtgtgagttgtgtgtgtgtgtgtgtgtgtgtgtgtatctccgtggaagaatgccaattgtcctttcatgggaaggaatggcttttattctgagatcatgtccttcctacatgattatttgtgaaatctccctttctttatgaaattataatggtagtagataaattttttaaaatttgacaaaatagagttggcctttaaaaaatggttttactacctttactgttgttgaaatcccaaatccaaaagtatagaaatgattgctctgttccagagagaaacagtagcgtgggataagaatttcaggggcttggtagtagcctgtgaaggactcctggtattcatgtgtgctttggtcctgatgtttattttaataggaaaaagttttatcaccgccaagcatggtggctcgcacctgtaatcccagcactttgggaggctgaggcaggcagatcacctgaggtcaggagttcaagaccagcctagccagcgaaaccccatctctactaaaaacacaaaaattagccgggcgtggtggtgcatgcctgtaatcccagctactcgggaggctgaggcacgagaatcacttgaacccaggaggcggaggctgcagtgatccgagattgcactgctgcactccagcctgggtgacagagcgagactctgtctaaaaaaaaaaaaagtttttttacataatccttggagctgccaaaaaatatttgttttcccaaatgagagagtaaagttttccttaccttggaaaactcttcctggttttctcatgatcttcccttgtttactttggtggtttggggttagaacaataacaacaacaaatatatctatatattgttttctgtttttatatttcattttaaggccagcagtaccacttctgaactccaacaacgagaaaatgtcagatcccaatatggaagctaacagtcattacggtaaagtcatgttctcctgccatttctaatttcccccaacttgctacatacttccttagccctctcagaagcagaatatgtaagtggtgggattacagttggaagagaaaccctggcttcaacagggtacttcatctcatcagccactgggccatgtaatatacggaaacgtaaaaggaaaggtaacatattttattctaactttgccaccttccaaactccccgtagaagaaagatggagaataatcataatgccttcaaagactttgaacattgctccagcgtaatattataattctccattttcaagacagagaccagatattgaatgaaaacattggtaaaacatcttctcagatggaattattacaagcacaagacagttttacttcaaatttgccacaaagggaaagcaatttcaatattctctcagtaaaggcataaataaagtgttccaactaagaaatatctattcataaggctcatcagtagcttcagggtcagctcagctgaatgagtagccagtcctaggagttcttaatcccaggttagtaagaaaattgctcaagcatttcagcagggatgctacttacttcccagagggggctataattacatcacaaaaagtcctgtcccagaccaaatttggaacactcttcctcttttctttctttcttttttttttagacagggtcttcccaggctggagtgcagtggtgcaatctcagctcactgcagcctctacctcccaggctcaggtgatcctcccatctcagcctcctgagtagctgggatcacaggcatgtgccaccatgcccagctaatttttattttttgtagagatggcactctaccaatgctggtttcagactcctgggcttaagaaatccttctgccttggcctcccaaagtgctgggattacaggtgtgagcccctgagcccagccacttttcttgctttatcagcaggtttggtcatagaatgctcatgttcttttctaattctataaatgtctcacaaaataagaaatttttaggatatactttttacagagacatattttgcttgagaaatatgttttaagaattgagtaattcatatagtactgaatcataaactttaaaaaaggaaaataaaatatttgtagtaataaaagtaatgtgtcagtaaatagaaacgagcaaatatattgtttaagaaactatattctaggctgggcgcggtggctcacgcctgtaatctcaacactttgggaggccgaggtaggtggatcacttgaggtcagcagttcaaaaccaccctggccaacatggtgtaaccctgtttctactaaaaatacaaaaaattagctgggcatggtggtacatgtttataatcccagctactcagcaggctgaggcaggagaatcccttgaacctgggaggtggaggttgcagtgacctgagatctcaacattgcactccagcctgagcaacaagagcgaaactccatctcaaaaaagaaagaaagaaagaaactatattcaggccaggcatggtagttcatgcctataatcccagctctttgggaggctgaggtgggaggatcacttgaggccaggagttggagaccagcctgtgcaacaaagcgagactaggagaatcgctggaatctgggaggaggaggctgcagtgagctgggatcgcaccactgcactccagcctgggtgacagagcaagacattgcctcaaaaaaaaaaaaaaaagaaagaaagaaaaaaagaaaaagactacacagcaggtcaaatggagcccacaggagggccaacgaggggacccaggacccagagacagtgctggttgtcactacactgaataaatcaggcttgactttgttaggggtactgaatttttaaaaggttttagaaaactagaatttcccttgtcactcaccctaattgttatttttcaactaggtcacaatgacgatgtcggaaaccatgcaatgaaaccaataaatgataataaaggtaattatctaattacatgtttttattagaaccaacttttacattaaaaaaaagactcataggaaaagaaaactaaaacttgaaggactgtggataatttcccacctctcttaatgaccctgtacccagccgatgtgtcaatgaaggtagctagctgctttcaccagagatgctatctagtgtcctcagtgggaaagtcacctaaatcaaagtagggaagaactgggttatactcaaaaaacaacttcctgactcataatgagctactgggtaaggcagtgggacctcttttttcttgagcattgaggtggtgatttttaaagacaatggacaataaattgctctcttctgcctgaagcactgagggattggactaaatcatttttcaaaattcctttcgctctgggctgctgccatgggagctaaggctcctaacaaagagaaaggattctgttaaggtctcttcctttctttcttttttttgtttttttcttgagacaagagtctcgctctgtcagccaggctggagtgcagtggtgcgatctcggctcactgcaacctccacctcccgggttcaagcaattctcctgcctcagcttcccaagtaactgggactacaggcgcctgccaccacgcccggctaatttttgtatttttactagagacagggtttcactgtgttggccaggctggtctcaaactcctgaccttgttatctgcccaccttggcctcccaaaatgctagaattacaggcgcgagccactgcgcctggctcttttttttttttttttttttttttgatacagagtcttactctgtcacccaagctggagtacggtggcacaatcttggctcactgcagcctccgcctctcgggttcaagccattctcgtgcctcagcctcccaagtagctgggattacaggtgtgtgccaccatgcccagctaatttttgtatttttagtattggtggatttttaccatgttggccaggctgatctcgaactcctgacctcaggtgatctgcccgcctcagcctcccgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactgcaacctctgcctccgggttaaagcgattctcctgcctcagcctcccgagtagctgggattacaggcatgcaccgccacagccgggtaatttatttattttttttttgtatttttagtagagatgggatttcaccatgttggccagcgtgaactcgaacttctgacttcaaaagatccacccccctcagcctcccaaagtgctgggattacaggtgtgagccaccacactcggcctcaataattttaaaaattaattaaagaaaaatagagacagggtttcgccatgttgccctggctggtctcaaattcccgggctcaagcaatctgcccacttttgtctcccaaagtgctgggattacaggcgaagccaccacacctggccatttttgataattattcgttatgatactactaataataggtaagatttattgagcacttactaagtgccagggaattaggaagtactgagcaatttgtcccttccagaggtagaccccctgccaaacccagtgtgttcctaaagttgcttgtgcagactgaatgtgtgtcaatcaaatgcatgtttcaagatatcgagtgctttgccatttagagggacacttaggtaaaggcttttgaaagcacaagatccctgtccgtgtgagcagtggcactgattttacaccttgggttttgtttttgtgtatgtggttctctcaagggcaggctggcctggaagtccctgtctctggttctatgctggggaaatggatgcagagtgggctgctccatagaaaatgctagaacatcaatctcgtttgttttgggcaccataaaaaacatgcatctcctggccaggcacggtggctcacacttgtaaacctagtactttgggaggccaaggcaggtggatcacttgaggccaggagttcgagaccagcctggccaacatggtgaaaccctgtcttccactaaaaatacaaaaattagctgggcgtggtggcgcatgcctgtaatccatctactggggaggctgaggcagaagaatcgcttgaacccgggaggcagaggttgcagtgagccaggatcaagccactgctctccagcctggatggcagagcaagactccgtctaaaaaaaaattaaaaatgcatctcctaactgtcctcctcctttgcgaacccagattgggcagtacacagtccccgggggtcactgcacactcctgcacgctcaaaggaaacagtggctcctgcacgctcaaaggaagcagtctcagaaccttcctgcccagctgggaagctccctgggatcattgccatctgtctcccttcctctgaggctaaccccaggctgcatccacctagccaggcaggcctggggtagttttcctgactgtgcaggctgaatgggtgcagttttccaggccgtgccagccactagccagaccacatggcaatggggtcctgaaatcaccccttgctccatgatctgggaggagtcttggacttctccttgtcttctctttttgagcctgggctgagtgtcagcagctgtatgcacagaactttccttacagggatgccccgtagagccgctgggctgtgtgctgcaccactggggcacattcccatagcctaccaacagaatggcccccgggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttcaagctattctcctgcctcagcctcctgagtagctggggttacaggcgcccaccaccatccccggctaatttttgtatttttagtagagacagggtttcaccatgttggccaggctggtctccaactcctgacctcaggtgatccacccgccttgaccacccaaagtgccgggattacaggtgtgaaccaccaggcctggcctcttcctctttatttcattgtagagtgattgactcgttgagataacaaattgtgattaaggccctacgcaggcagcacaagcacatacagaccctcccttgtggagggacagcctgagaggcagccaggaacacactgcagcaaagccctcctaaccttcagggatcacctaaccttcagtgatctgcccacctcagcctcccaaagtgctgggattacaagcatgagccactgcgcccggccctggttttctttttcttgctcaaaggtggggaagggttgaagggacaagaaggaggtattgtaatcccagcactttgggaggcagaggcgagaggatcacttgagcccaggcattcaagaccagcctgtgcaacaaagcaagaacttatttctacaaaaaatttaaaaataaggaggtatcgagaccctccaggattgggtgaagcagaggcggtcagcatgtgccctccttgccaagctgtgcagctgcagggatgccatcacctaactggtccctctttccccatttgcacaaaagctgtgtgggctgcagaggtccaggtagacccgtaaagagggtcacttgggggcaatggagagctttttgggaattcaatttgagttttctagacccgtcctcctccttggcagctaaggagcagtgtgggaagtcaggcctgagcctcaggtgttccctctctgccttcctgtgggtggagagccaggtattaccaggtacgaaaaggggctttgtgggtacaaggccagtggtgagtacatttgacctggtcttgaccaagccagttccctgctctcaagacttcctcctcctatggaggaggggttgggaaccacatccagctctgaccctagtggcagccgaccaagtggtcacttggggtggaggaggggcaggaaggaactcagtaaatcctggtttgctgcatgtttgctctgagactaattgctgggaaaaccccatgacgttgaagccatctccttctctgttaacacagagaaaaacagaagccaaaataaagccccatccggaaacatccctgacagcagagacaaagagcctgccagcctggtttactcattagcaagcagctgctgccgtggagtgggtggggaggagaggtagtgatgagctgcaactctgcctgcccacccatcacttaactgggcagatttgggggcagctgcaactctagaagctccaccaagaagcagaaacccccaggcccaaacaccaagccctctccctccatttattcctcacctgccccagcccccactgtgggcctgggtcggagggtgagctggccgtgaccaccccaccatgcgcctggtatatggtgtttgatagcatttgttgcagtgtctgcgttgtttgtgcacctgtctgcctcacagcctggagctcctgaaagctgggaccaggcccgatcacctttcctcttccacagtgcggggttcacactaggtgtctaggattctgctgagtgagtgatttggccaggcctgacatcaagcagagggtgtcttggggatgtggaggatcccccaatagggttggggatccctacagcttcccttgaggcccccacatctggtgccacagaaagagagtgaggggtgtgtgggcatctctgctgtcccagcagtgtggtgccctggtagctcagccactctactgagttccaaatcctgtttggtgccctggggaagtcagtgtaaggccctagtcaccccaaatgccccaagttcaactgtagggatctgacccacccccaggctttctcctcacaaatggttcctgacacaggagccaccaccattactgtcacttcaaacttggacaggtgcccccaggcagctgagcaagcctaggaatgggacatgtccaagaccccagctgtcaccccataggaggtcggggtctgccagggagacggacttgggaacaagtcacatcggtgtgttgtggacaaatgtcaccaacatgctgtggagctcagggggccctgtaacttcccagggcacagagggagagtgagtgtgggtgtgttggtacatgcgtgaagctccaccagggtcgtggggaaatggggcaaggagaaagggcagtgctggctgtggaggagtgtgtgtggggccaggaagtgagagtggggtgtccctggagcatggtgagacaagggcatctcagtgcaggtagagtccagggtcacaccccagccattcactccaaggagggaaatgcactgaccatggcacaggaagccccttaccctatctggggcttcctttccccatctgtaaaaggagaacagtggcccacacgacatcaggctcttttctacagtgaggcttcctgggcctttgtgcaggtgacaggagctgggaagtggccaggttccatcctgtttcctcagggttggtgggtatgtatgtgtgtgcacaccctgtgtgcatgagtgtgtgcacacccagattgcatgtttgtacatacagtgtgtatacaatgtgtgtagacacatcctatacactgtatgagggtatacatagcatgtatacacattgtgtgcatgagtgtgcgtgtgtatatgctgtgtgtgtatttttgtatacacatcctgtgcccataccccagtgtaaggtaaacagatggcaggaagggcgcccttgagtctcctccaggtatacgccacaccctgggtcagtcatcatgctgccatattgagagggtctagcccagaggatctcagccctgtctgcatattagggcccctgaggagatcctaaaaaaccagcaccagggacccccccagaccaatccaaccagaagctgcagtgaggcccaggagccagcagtgaaaacagccagcccagctgtctatctctgtaagagttctcagtcccagctattcctagggtcactgacaacccccaggctctaacccagacctcaggatcttgttctggatcccggggtctgggctctcaggtgattgggaggccatagcccaaccctgcgttgagggacctggcagaatgtctggacaagggtcacggtggcaggggaagaggagtggggccagcaagctggaggctgcaggcccttgctgggggcctctccatccgtggcccctcaggtccagggttcctctggtgcatgtggccctgctccacaatggcctgctgacctcctattcccagactgggagtgacgctcgttagaccaagaccttcttcttcttcttcttttttttttttttgaggtggtgtgtcactgtgttgcccaggctggagtgcagtggcgcaatcttggctcactgcaacctctgcatcctgggttcaagcgattctcgtcccttagctctcgagtaactgggatcacaggcacgcaccaccatgcccggctaattttttgaatttttagtagagacggggtttcgccatgttggccagaatggtctcaacctcctgacctcaagtgatctgcccccctcaccctcccaaagtgctgggattacaggtatgagccaccttgcccagccaggatcttctaacatcagaaatgacaaggtctctgggtgcttctggacctggttctggtggggtgcagtggtggggtacagccttgcctgcagagcctcagaccttttcctatgactgcagtggactgacctcgttcccagaggcagctactaacttatgcctggtcctttttccagatctaggaaagaaggacacagagacagtgtacagtgaagtccggaaagctgtccctggtgagtgagggtctccagtgccccagcctgggggatgccccctagaatcactgatggggccttgggagtgggcagagaaaagaagaagcaaagaaggccaaaaaaggggtgccacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgttttcttttttctcttttttttttttggatatggagtctcgctctgtcactcaggctggagtgcagtggtgcaatctcgactcactgcaacctccacttcccggatttaagtgattctcctgcctcagcctcccaagtagatgggattacaggcgcccgccaccacactcagctaattttttttttttttttttgagacagagtttcgctcttgatgcccaggctggggtgcaatggagcgatctcggctcactgcaacctccgcctcccggttcaagcgattctcctgcctcagcctcctgagtagctggaattacaggcatgtgccaccacacccagctaattttgtatttttagtagagacggggtttctccctgttggtcaagctggtcgcaaactcccaacctcaggtaatccgcgcgcctcggcctcccaaagtgctgggattacaagtgtgagccaccgcgcccagcagcttcagcttttctgacagtagactgactttgggagtgggtgtgggtttgcggatctgctctatttcctttggttcggctggccccacttcgcttcccgtgacgacccactgcttactcatgaaagggcttcccccagagctgagcacagagcttaagcagacccggaactgggg

SEQ ID NO: 51 - DNA, 1753 bp, Homo sapiens
ttcattttttcaagtggaaccatggaggagagtggctgcccaaggtggggtttgtcttttgctgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatcctgctcccaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacgtaggtcacaatgacgatgtcggaaaccatgcaatgaaaccaataaatgataataaaggtaattatctaattacatgtttttattag

SEQ ID NO: 52 - protein, 297 aa, Homo sapiens
TGHRDGSASCSQMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKANKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYVGHNDDVGNHAMKPINDNKGNYLITCFY

SEQ ID NO: 53 - DNA, 42203 bp, Mus musculus
  misc_feature (1)...(42203): n = A,T,C or G
tgacccacaggttgataacccttgctctgggagcacctgttggctccctgctagtggtggctgtcaacattcttcctttggtagctccaccgccccaggttccaccacctggtgcatggccccatctctgctagctgtcccttggtctccctccatctctgctagctgtcccttggtctccctccatctctgctagctgtcccttggtctccctccatctctactagctgtcccttggtccccctccatctctgctagctgtcccttggtccccctccatctctgctagctgtcccttggtctccctccatctctgctagctgtcccttggtctccctccatctctgctagctgtcccttggtctccctccagaggtgtttcctaatgcactggggagatgcacttgtcaagaagatgctgtgttttcactctagttcagcgtgtgcactcagtgtcgaaggagactagaagatgtcagagctggaactggagttccgggtgatgatgtgggtgccctcggaatcaaactctggtcctctgcaagagcagctggtgctcttaatcactgagccgtctgtccagcctccgtgttctgatttctgataggaggcagtgctactcttaagtgggttggctaggctcgagttcacattggtaaagtgagtaatggcataagcagatgagctcttctttcacgggggctctcatatgatcatcttaagtaggtaatagaaaagggcccgggggcaaataccttatggtaggaactgtagaaattattgtgggggaggggaggctgctgatactactctagctgcttctaatataaggctcttcaaatgtacgcaaagggagggctctgttttctctttgatcataatgtgagctcaggtcattttctagctcctagcactggagcgaacacaaagctgtctcatcaaccctgaaaaggctattgtacggcgcgctccgagggtctgccgccttcaaacctggctctgtagtcaaaaatcagcacttgggtgttttgttttgttttgttttgtttttctttcgtgttcatcatgggccaggcagccgcgtgtctgttgatatcaagaactttgagcctttctgtcactattccgccccgtgatgctccaggctgtgggttgctgtgtgtgcgtgcatgtatgagtgtgtagtagtgggtgactgaaaaggagagagagagagagacagagacagagagacagagacagagaaacaataagggaggaaggaggaagagacagaagagtggagggtggtggatatttctgaacacattcacactcttcttgcatgagtcaaaaatcacatacaatcccattaccctaagaaaaccactattgtggatgtgaaaggtcctgcaccggctggtggtttagaacccctgatcctcagctggtgggcgctgttgctggtttttttgttttcggttttccgagacagggtttctctgtgtagccctggctgtcctggaactcatgttgtagaccaggctgtcctggaactcagaaacccgcctgcctctgcctccctagtgctgggattaaaggtgtgcgccaccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgtctccaagggacaaaggatggactctggataaagtaggggacagaagtggcccataggcaaatgttggtttataaaggtaaaggggaaaccctacattaggatgagatgttcaactttaactgagcacgctaattaggtgagccaaagggagctttggatggctggactttaatactttgatagctggaccttggtcatcagcctcaggaggaggaagtggtcaaataagggaatagaccttggtggctggctttaggaatgtaacctaatggcttttagcaaggcagagggaatgaaaaagaagggcaaggtctaccagagctgtattccagctgctcagagtcccatcaggcctgccccacagcctgatcttatggaggcattttctcaattgaggcttcctcctctccagtgattttagctgtgtcaagttgacataaagctagccagtatagcaaataaggacacttgcctatgcatccaaggatggccttgaacttgtgattctcctgcctataccttcaaaccactgggattccgggtatgtatcctcatgtgtgattttctggggtgctggggacggaacccatgcattgtagacaagtgtgctacccactaaaccacacccctagccccaaggatagaacacctttgttgatgctctgcatgggttggcgtttgtccttgctgcaaaatgaggaggagccagagatggttttgtatctaatacgttcttgtttatatttagtaaccacggtagccaggctgagtgggatgtcttagtgtgtaaaagcacccgcctccatcctgatgacctgagttcagtccccaggacatacatgacggagagggccgaatcctatgagttgtcctctgacctccccatatatgtcctgatacatgtaatgcttccctatataccctaaaataaacaaacaaacaaacaaacaaataaaaattttaaatttcaaatagggaatggagagaagggctcaatggttaagagtgcttcctgctcttgcagaggacctaaatttagttcccaggacccacattaggtgtctcacaaccccctgtaaatccagcttaaggggaagtgatactgcccttcgggtgtgcctgcacttgtgtacgtacccacagacagacacacatttaaatgtaattaaaactttttttaggtctgggttgctggctccttacttaagagtgtgtacagttcttccagaggacctgagttcaattcccagtacccatatcaggtggctcacaactacatttaactccagctgcaagggatctgacacctctggcttctgtaggcacctttttacttatgtgtacaagcttacacacatgcaagtgcacacacacacacacacacacaaataacaataaaatttaaaaaattaaatacttttggtaggcaaaattatacaacaggtccaaattgggacaaaccttctcctgatggttcaggcaagagctactgcacaaattcccaaggacagaaagtgtggctatgcagtttcttcaccgtaaaataggaagacaattccctgggggaaacagtaggtcctaagctgatatgtgtgtgtattggggagaggaagtatttatcagaccagaattagtataaaagttgtaataaaggattagagagatagctcagcggggaaaagcccttactacatttacagaaaatgtgttctcttctcggcactcatatttgtggctcacaaccactagtgtaactccaaccccaagagagccaatgtctatggtctccttcacaggcgactacattcatgtgcacataaccccacacagacatatagacataattaaacagaaaaattaatctgtaaagttatgaaataaaaatagacaaggtggactgaaactgtaactttaaaccctgttcctatggcggtgatgcccagacttctgacttctgaggtgggtgttgataaatcccattgattatcagcagcctgcgttcctcaatttgttatttagtgatacaaaggtaaaagcgagttcttctacctctcagtctcagccctacaaaattatttgaatacagagcatcccagcatccacattgctagaattcattgtatcagtgtgtagctggtagctgtacccattgctctttccaaatactgaggctgcttttagcaacactgtaaggaaacagtgtagagccaagtctgtgatccaggtctgcagtctgcaacctttaattgggctgaactcaaattctccccaacaaggggtccatcagcaaagctttttcctggctacaaaaggtgccttccctttgaattgtaaatttactgattcttttgactgaagttttcctgaaaggtgttttcttttttttcccctctttgtatgctgtgtgcccattacttgtgtcaattggaaggtttgttgtttttattcgttttcttgagacagggtttcctctatgtagaccaggctgacctcgaactcacagagatccacctgcctctgcctcctgagtgttgggattaaagggggtgcaccaccaccaaaatttccttttaaatcggggacgaatacatagttgtttattgtctcctcagaagttttgtaaaatggcttctactgccatcaagcttcaaaaagagtcaccggcttctttgcgtttaaaaaaatattttgcctctcttattttaatatttcttctcctgagactttagtggcccagagtgtgaggttgctttttttcatgtttagtagcttttcccaggagaatcaaacaattgtcccttttctccctgagttataaatccttttattattgtgagctttttaaaccttttagttatttaatgtgtgtgtgtgtgtgtgtatgtgtttgtgtgtaggcatgcccgtgccacagcccatgtgtacagatcagagggcaacttgtgggagtcagtcctctccttccatcacctgggtcccagggtgcaactcagggcggtcagtcttggccgcaaatgctttttactcactgggtcatcttgccagccttgggcttacttactgttatatctgtgcttcaagacttcctcattgtctttgtcctcgttaacctttcctaacagtctaacctaaaacacacatacattttagctgcaaactacatggcctttatgttaataaagtaagcaaaacctttggagaccacgtctcatgtagcctagcatggccttaaaccctctctggagctgcgaatcaccttggcttttctgcctccaccccccaccccccagtgctgccaccacaccaaggctgagattatgcttaagaaattacaaagtggggctggagagatggctcagtgggtaagagcactgactaatcttctgaaggttctgagttcaaatcgcagcaaccacatggtggctcacaaccacccttaatgagatctgatgccttcttctggtgtatctgaagacagctacagtgtacttacatataataataataataataaataattagtcacaaaatgtaaattatttaaaaaaaagaaattacaaagtgataattaggggggctggagagatggcttaaaagtgagaccacttgctcctcttccagaaaccccaagttcggatcccggcacccatggatgcctgtgatgccaactctagaagaggcagcaccttcttctgacctccaagggtacacacacacacacaaacacaatgaggctggatgtgggattaaagagcccctttgatcctggcactagcaggctgaggcaggtggatccttgtgagtttgatgccagcctcacctacctgttgataagaaatgatcattagcaaagggcaggtaggcatggctgcacacctgttggcatcttgaacatcttgcaatgcacagaaatggaagttttttttttttcctcttcgcctttcttacccttcccctttctaatgtcgaatggttaatggtcacagacatcttgtgcgttttaaagtgcagggggaaaagtgccaaaggagtgccgattttcttccccagagtcaaataaaatgggagctcgaaaagactcatctctctaagcagacagtctcacaccctctattaaaagacacccagagtcatcctgagagcagggctaatacatccgtgcacacactgctggtgggctctgctttgatttttttttttttttcttaacgtacattttcacctgttcagtttttcccgaatcctagttgctacttctactctggtataaacagaattcatgacagctgtccacatctaagtggagtcagaggactgaaagcacggcccatgacagcaatgtggccccggtgtaggggatgagcagaggccctgccagcgtcactccctggggaagtagacaagtctagaaaagcagaagtggcttgagtgccgaggctgagcagctgggaaatgatatttcggggcctcattacctggagggacttaaatacccacctgcttccttgtacagggcagcgatgacaaaccaaagaatggttccatcaaagcccaacttgggagaccagtgagatttgggcttgcttacagaacttgcgtgacgggttattgacaggagtgtgactgacccaaagtggtcacataagaaagtcttaccccagcatgggcgacaacttcccaggtagtgtagatgggcatgctctaaagtctgtacactctaggggctcctgagacagtgaagccagaaatacacactgctatctgggcggtagaggggtgtggacagagtctcctgggagggttcaatgactccacccacttctactgtaagggatattagcagcctacccctctcctccatacattcctccaatcttgctctttcaaatccatggcccctttgttgtgcatttattgttgaagtcattaagagaaaacattttaagttatgcgtgctgtgtgtgtcagcaagcttacctttgcaaaatggcagctacattcctaacgatagctcagggacctgaagcatgtggagtggagtctcactgaacctcttaaagtctgagtcttggaccaagcccaagacgggcccagccctgcggcaatggcatctgggaagactacactcaggctagcgtgccctgactcaaccgggattgagtgggaggaaggattgtccaagtttctgtttcactcacctttgtgtagcaagacttccaggtctgcatgtgaaacctctcccattttaaaaacttgtgtttaattgtgtgtagctgtccaagtgtgggtttgtatacccaagtgcagtgtcctcaaaagccagaacaggacatcagatgacctggagttggagttacaagtgtttgtgagccacactacatgggttctgggaacctaactcctcttccctgcaaggcctgtatgtatgcttaacggccgaatcatctctgcaacgtcagcctcttcattttcaatcactggctcacttccagctggtaacagctctaccaagatatggccaatggatcatgcggtttaccaacttcacatgaataaagactgtgttttattttattcataggtcctaaagtcttagggttccattgctgtgaagagacaccatgaccaaggcaacttttataaaagaaaacatttcactgaggctggctcagagttcagaggttcagtccattatcatcatggcaggaagcatggcagcgtgcgggcagacatggtgctggaggagttgagatttctacatcttgatcctaagaaaatttaagcacaggagatctcagagcccacccccacagtgccatacctcctccatcaaggccacacctcttaatagtaccattcctcttgggccaagcattcaaacccatgagtatatggaggccaaacctattcaaaccacaccatacaactaattttaaggcatgcatgccccaaaaccgtgcattctggcagtcactctctggttgtacaatgcccctggccttgactgggaacccttgcctaacatgacatttgcctatttcatatatttcaaagaaaacaagatcgtgctgaggactgttaaggtggctcagctgttaaggtcatttgttgttcttccagagaaactaactttagttcttaggacccacatcaatggctcacaaccacctgtaactccagtttcaagggctatggtgttttcttgcctctgagggtacttcgtgaatgcacatgcgcacgcacgcactcacgcacacacatgtacacacaaataaaagataaccaaatatttatagaagtaggatcttacgatttgtgtaatttgttgcttgtttgatttctggtgttgtgcctgaccaaaaacaacttggggaggaaagggtggtctttcaggttataatccttccaaaagggaagtcgggatgggaacttgagacaggaagttggagaccggaagctgaaggcaggagccatggaacaatgctacttatttgtcctgctactttcattatacagccgaggatcacctgcccagggttggcatcacccacagtggggctgggccctctcacatcaatcaccaagcaagaaaatgctctcacagacgtgcccacaggccaatctgttgggggcaattcctcagctgaagtttcctcttcccttgtgtgtgacattgacaactgaagctaactgtgccattgggtcacttcccaccaccacctccaacactgtgaccacactagaatattctgcattctgggtttgtctccatcctcaaagtaccaagttcaggggccccagcacactgcctaaaattcctccctccacacacttaactccaaggcccctccgagccattagcttcgccatttccctgaagagactgacccatcggattagttagtaccagtcagactgcgcagtgagttaccagctcagtcagtccaaatggtttattagccttatcattccaatacagagtttgttcaagtatgtcatgcttagcttagcagaactttttctttttaattgcctgtgtctgtatgtgtggacatacatgcagtgtctgctgtctatccattgtgtggggctcccagcagggggatagaactcaggctatcaccaggccgggtagcaagcacctttacttggtaagccatctcactggtccagtctttaagcaaacgttccaagactcagtcttacttaccagcaggactaagagtcagttataggctgtaaataaaggttttggttttagtttcttttcttttcttttcttttctcttcttcttttctttccctttctttctttctttttcttttttcctttccttttttttttttttttttttttgagacagggtctcactatgcagccctggcagaactcactgtgtcgactacactggtttcgaactcacagagattcgcccgcctctgcctcccaagagctgggattagtggcatgtgccactaaagatgtgtttagttttatgtgtatggatgctttgcgttcatggaggtctgtgcaccctgtgtgtgtgcagtagccctggaggccagaagaaggtgccggatccacgaggaactggagttacagattgttaggagacacaaggtgggtgctgggaatcgagcccagaacctctgactagcagccagtgctcttaactgtggagttatctcttcagtccttaaaataataataataataataataataataataataagaagaagaagaagaagaagaagaagaagcagcagcagcagcagggcggtagtggcgcacgcctttaatcccagcacttgggaggcagaggcaggcggatttctgagttcgaggctagcctggtctacaaaatgagttccaggacagccagggctacaccgagaaaccctgtctcgaaaaaaaccaaaaataaataaattttagtaatttttgttttaagaagagacagaaaagtgagataccaagagagggagaggaggccgagactgttacacttgacgcctgggtcctgagaagatggcaagaagggaagatttagaccctggtgacctggattaggaacccagtttggggccggaacctcggagtctagggttccagtttcccggtggaacccctccagccataggaaccaccatccctccacgcatctcaacaacaaaccgctgtcaagtgaaaggcccgcttggccggatttccgggggcggaaccggcagccacccccgcccagcttgcccagttaaaaggcggcggcgggagagggagggaactcgctgtctcgcgagagttgggctaccgagtcctcagtgaaccggccatggagggcgagcgggcgccgctgttgggttcgcggcgtccggcagtgtcggcggcgtccgcggtgttcgcggggcggcgtgcggcgtgcggggcggtgctgttggccgagctgctggagcgcgcggccttctacggcgtcacggccaacctggtgctgttcctgaatggcgcgccgttcgactgggagggcgcgcaggccagccaggcgctgctgctcttcatgggcctcacctatctgggctcgccgttcgggggctggctcgccgacgcccgcctcggccgggcccgcgccatcctgctcagcctggccctctacctgctgggcctgctggccttcccgctgctggccgcgccccgctcgcgctccttcctctgcggggacccgcggcccgagctcgtgcgcaactgctcggcgcccttccccaacgggtcagcgtcgtgtcccgagaacgccgcgcgccgctgtgcccccgccaccttcgcggggctcgtgctcgtgggtctcggggtggccacggtcaaggccaacatcacgcccttcggcgccgatcaggtgagccggacccgctcaggtcttcccgggtttggggaccaccaccccccccccccccgccgcacctcctgcgcaccacggctacccgaacctaagcgttgactttaacaacgctggggacacgggggaactggcacggtagcctgtgtatcatctgcacctcctgtcccccagggttcttccactgattggaaaaaaggagccaccccaaacacctaagcctacatccccacttgcctctgcacctatgcgcaatcgatcggaaagcacagggctgcccaccaagcttcccaacccatagacctgcaccccacatcgcctcagatctagagaaaggttaaggtgagggagaggaatttcccaacccagggaatctcccttgtagtgcagagaagaaggccacctgcctctgatccctccttgttagtggaggtgaggaaggagacctgctcttcccttggagagtggcaggaggaaacccatctgctccaacacccgagtgggtaggaggaagggcaagactccctctaatgcgtgtggggaggaagcccatgagtagaacccattccacacctggcactaggtccaggactgagtaagagggagtaacagccccttcccctcccctgtgcgcaccgctgtccacatctgctcttgcatctggtaggggactgtaggaggggagagaacaacacccaccctctgctctgggggagctttgtgtgtgtgtgtgtgtgggggggtggtggtggaagtactggaataggggaaagctgtataaacagttatgatctgggtggtaaggaagagttgaggtgggatttattcgtgatgcagtaaccattgtggttttaaggagaagggacgttctgttggtggagtcatctgcgttgagatctgaaagagaaaagggtgaagttatgacttggaggatagacatgtacaaaggctctgacactgccctagcttcccttttacaaagttaggggcaagagacaggcaagcgcttagtttccatctttaatgctttaagtaagttttggggtagggtgtggcaggtgggaaagaccagcatcattcgctgctactctgacatccaagaacaagggatgaggagggagccagagctgtggagccacatctgctctgcttccctttcttaggggactcccatgccaagaatagttctagtggtcagatgcaaatagagtattttgtaagcagtggaaattatgtggggtttgagtgtcaggctctcaggataaagcttgctttcttcctttctttcttcttctttttttttttttggtttttcaagaccgggtttctctgtgtagccctagctgtcctggaactcactctgtaaaccaggctggcctcgaactcagaagttcaccagcctctgcctctcaagtgctgggattaaaggcgtgcgccaccactgcccagcttaaggtctcattcttaattgcttacacatccccgacctctgccttccatggagctgtaaaactgagtaaagcaggggctagataactcctaaaacagaacacgtgttgtcctgtttcagaaagactgcaaatagctatcctagagtgcgttgtgtgccaggagggtgagagcacggctcagactaccgctggtctgaggagagaagtgtggcctagagtggaggcagtgccttggactgaaggttgcactcagattgggaggctggctataggaagtgctagagggttatttgtgtgtaacagggaaggtgagccctgggtcttggtacaaaactgatccttgagaagctgaaattgaagtcagcagagcgaagtcatctcagagtagcaccacaaatgtaggactgactggccagtgttatatggtgtctgtaaggctggccatttcggagaggacacaatctcaacggtgtcagaagtagtagtgatctcagtatttaagagattgaggcaggaaggttgccacatcacatattctgggctacagagcaagactgtgggtcatacaagtaaaatgtaaacaaaagaagtgttgctacttgagagttctggagttctcagaggtgttcatcaaactttcaagaccagactcctggccttggcctctgttccactagtatatattacctctgtcatttaagcctaggtgtggtggtttgcatgaagtggccctcataagcctcatatctttggttggatacttggtccctagttggtgactggaggaagtatgggtaggcattttatcttaaattgtaactgctgctctagtcagcagtctgtcttgccatgatgaacttgaactgtgagcccaaaataaacccacccttctctaagtggccttggtcatggcatctctcacaataaaggaaaagtaagctacaccctgggtcatagtagtacataagttgtacctgtgactgtacatccctaccttgagcggtttgagctttctgatgtgcactgggttcttgtgagccatcatgtggttgttggaaatttgaattcaggatctctgctcgctccagcctaaagatttattatatctaagaacactgtagctgtcctcagacacaccagaagagggcgtcagatctcgttactaacggttgtgagccaccatatggttgctgggatttgaactcgggatctttggaagagctgtcagtgctcttaaccgctgagccatctctccagcccccccgtacactgggttctttagactttccactcacagccccttttcatctgagaactaagtgactctgagataaaaataaataaatattaactgatgtcaaccaagtcagatttattttaaaacagtccttttaccatttattaaagatgaaatccagtttgtgtagtaatgagatgcatgtttataaaacttgataacagtccaaagacagtaactccatctttgaaagctgaagtgtgatgggtggtagggaaatagcctaatggttctttgaaattaagccattatgcttctataagaacagaaaaacattctctcagctcatagcatgttggcctcaaatgaagccagggtgtgccaggcagcatttgttggtgtcatgaagcatgtcactgtgtgaagtgtaaagttgcaggtggtacttgtacagggtcaggactgccaggaacatcttgggtccactgcacatttgattctgagttaagttttgatccttgtgcactcagaaacctgtcactgttgccaggttttacacacatacagttggagaagctttagttgtgtgcaccgcgtgactgtcagagcccagctgctcagggaacagataggacagtgtgtcttagagtcagtgctctccaatagatactagatcagtgattcgcactcttaacagacccactggatggctcccgtgagggtcactgagtgggtgcagtgtgcacacttcactgtaggtaagagtaggtgctcttgcacagtgtgagtgctattgtctccagtgtctccacacttacaatcctgggaagagaccctcgagaaacttgacagccactttgggtgtggtcagtgactggctctgtcgtgattttgttttctgtttatgagttttgttatatttttgagacagagtctcagtgtagctcaggctggcctctgattcactagttgaagatgactttgaactcctgatactcctgcctctgcccaagtcctgtcctcccaccatcctcggctatttatttatttattttgactgggtgtttttctgtgtcgcccatgctgtcttcaaactcactaagtatctcagatgcttcttcaaacccgcaataacctctgacctctgacctctgactgctgctttgagaagtgtgtgccaccatgccaggcctccagtggtttgtttttgtttttgttttttttttttttggtttggtttggtttggtttttgagttctgttcttgctctgtaaccaagctggcatcaaactcattgtgatccttctgcttttgcttctggaatgctggaagtttgggtgtatgtaccccacccatttgtctctcttaaagggcttgctttggttgtttgggctgtttgtactatggcctgcacatcagatgtgggggtggtgttcttaggtgtggtggtgcctttgtgactgcatagaaaagtggtggtatttttaggagattctcagtcacagaatgtgtaagcgtgttggggggtgtgtgcgcataaattccctctcattcacacatttgtttgttttgtttttgagacagtgtctatctgtgtagccctggctggcctggaactcacagagattgacctgcctctgcctcttttatacattttgtgtatgtgtgtgtgtgcgcgcgagtgtgtgtgcgagtgtgtgttcatggctatggtgtacatgttgaggttagaacaacctgcaagagtgagttctctcccatcattcagattctggggatggagtttgggttttcaagcttgtcaaggttgcctttacctggtgagccattttatcatgttggcctagaatattatatttttaataggaggaaaaagctaaaaagaagggtacatcctattttttttcagcttttctgtagctttgaaatatttaaatagaaagtagggtgcagtccctctggtgatgaaccttagtgcactctgttcattcacctgtaaaaatgctgttcacccacagcactagagttaggttcttgtgggtgctgagagcaccacaggatgtgaaggatgctcacacatccagtgagctgacacagggcctgcagggcagggcagtggcggcttcacaactctgaatatacaagagatggttggccacacttaggttcagtttgtggtgtgtaaatgatatctttagtaagtagctgggatcctttggaggcacttgctctctgctgcctcaagactgcaccttgagggagatttcaaggcctccttgttcttaacatgtctgctgctttgcaggagaagccaaaatgactggaaggtgctttggctatgttttctgcatagggtcagttcttgctggtctttccctgtaagagcagtgtgctgctatctttaaagcgcttttctggctggtgctgcctcttgactctggatttagctccagagtggctttcttatatgggaggtgggcctgactgtgggtgaacaggaataccaggtcagttcacagtgcctgtagacgttataaagtcactctcaaatgtggtttggtttaaggcagaattcatctgcccttaatttttcacagtgcttacaaattgccaaaggtcattgtcattcttgattgctgattattcaaaaaagtaagctaagtgctaggtgcttgtctatattccagtgcttggaaggtggggcagggaatccagagtttgaagccagcctcagctacataggaagttggagccccgcttgggttactcaagaccttaaaccaacaagcactaaaaaacagaattaaaaatagctgaaagaggaagaagctaccgtgcagacagtgctgccactctcgtttggtttagtttacggtctgacttctctgtagccggcaggcattctttgcttcagcagagattctgagtgctaggattatgttgaacattggtcaggacttcaggatggtgtttgtcccagtggagagaggttgtgttcctaggtatctgatagctttcccctgtttaaacacatatcccttttgccctgctggcctctcctctccctttggctttggtacttttggagggcgttggccagggcatatgaagagtttgatcagtcttggcaggcatgtggtgatgtcatgggactggtacatggggaagctgtggctttttgccaagggcagagagaggcatgtgacagcccagtttgctggcctgtggctactgaagccctgggagtaggcctctgtttatgaagcagctgtggctggtaacccttggacagtgaagtcagttgaccaccaagttcacaaagggacataaagactttaaaagtctgtatgtcaggtcaactgaataagtattctcttactgttttggggataagctgttcctatgaatgtgggaagatgtgtatggtcctgctatgtgtaatgggaagggtctgggacatttcagttagtatctgtaatgtttcctgtaacgtgctggacattgtggtgcacatctgtagttgtagctgcttcacaggttgaagcaggggatcatacaagcccaggagtttgagaccaacctaggcaactgatcccatgttcaaagaggtgtgcttttgttttgcttcttgtgtaaagtggcctcttttctctcagggttgttaaaacagtgacatatctatgtgtatatggtgtttatacatacaatgtatgaagtgtataaataataaagtatatgtgtgtgtacattgagttttattttctctatttcttgctcatgttttttctttcttttggcctgtctccactggtcatggacattgatgtccaccattgggtaacattaaagacattgtgccccagctgtaagaaactaaatataaactgttctgaagtgatgtccacctttagagtggagtctttgttcagaactgacgtgtagggcaacaaaatgcttgtggtttgttggtcatttggggggctggaaatggagtttagtggtaaaggagttgtcttaacattgcaaggacctgtgttcaatccctaaccctgaaaaagaaaagaacaaaccaacaacttggatttttcaatttgctgtgattgtaaccctccaacatgaggctggtgaagtatgtgtctgtgtgctcaggatccgtctttggctgtgggtttgctcaagaaaatttgtgaaatgaaactgtccagaatcatgctgagttggactgggcccattctcatagtgttcatggtagatagaaacagtacaggaagaagcgaggttgggatcgcagaaggcttgcatgggggcttgggggagagtcaacttgggactaattgtaagcattgcttcaatgtgctgatgagatcctctgcagctcagccaggattcagctcatgattcccctgcttttgtctcttaaatgctgggataataggtgcgccccactggataacctttctaatctaaagctagctcatgcttctcttactgtgcttacagcttagttgtaagcttatcaaaaactggtacttgggccccatgcaggagtggtgccttgcctccgagcaagccttactatgcatggggcaagagcctgccaagcaggctctcatagcacttgtgttaagtttagtgagctctgagctcagtgtactacgtatgctccctccgctgtgggcctggactgggcagctgtgggttctggaccctgtttcagggaccattcccggtggcttcatggtggtcagctgactttgagcactaggacttgctggcatttggagaggcatctagctgctggagggattgagtgtgagatggcttttgtcaggagactcgctgaatctgtaaacagcactttgacactgtccttcttgagatcctgtgtatctgctttcaatttgtagatgatcaggtgctaggtaggtatggtaatggcatatagctgctgtgggtggttgggaggtcattacatatgaaaacactacagcttgtcatgtttaaagagtaaacggaaggtgtagaagatcacattttcttatgcatttctcttctctcttactttaggttaaagatcgaggtccagaagccactcggagatttttcaattggttttactggagcattaatttgggagcaatcctgtcattaggaggtattgcctatattcagcagaatgtgagctttttcacaggctacctgattcccacagtctgtgtggccattgctttcctggtcttcctctgtggccagagtgtcttcatcaccaagcctcctgacggcagtgccttcactgacatgttcagaattctgacctacagttgctgctcccagagaggagggcagcggagaagtgggtgagtgacacaactccttgctccccgcagagaaagtcccagctgagggctgggctgtgtggtttgtgtctggtcttctagccggcttcattcaggaagtatgtggtataaacccctccattaggatagcagagccctgagttcaatactctgcccaactccttcacttccagcatgggtgagggtgccttgctgctgggtagcagattttgaaggtagggtctgcagaagatatcatggagacattgcgtgctttagacacggaagtatgttaatgagaacttaggctcttatgtatgttgtagcttcttgtctcaaaaggaagctgttgtctcccacattggtcaaaacagtttccctagtccagggccacgccatctactttgtattagagggacacatagcttgagatgctcttggcaacccatttacccttacttaaatggggcttgcacagccttagtgctgaaggtcccaagcgtggaactttcagaaatagccattttctgagctctgcccccttttctactgatggtgatccatggtgcccaacataagtgaatgaagtccagaagtcatcctccgaaggacttagatgcttctatgttttttgcaggctgcttgactgtagttgtgatgtaagagagattgtagaattgtagccaccagagcagtcaaggaatagaaaaccaaggtccagggaccttggtggtcagctccctccctgtgatttgccgaacctaaggactctcagtagttactgagagaggtagattccttgtccatggggcttcccatgggatggccctgcttgcaaaagtattctgcatggcagtgtgcacacctcctcatgtgcttgtctgtgcctgacattggcgtactgggagccatttgtggcagatctgaagctacacactgtgactcctgtggctctgctgatggcacatgagtcccttgggtgaaatctgactgtcccaactccccttcgtggacctgctgggaaggctgtgtgctctgtcagctttcagacccagtctagaagggaactaacacttgaggaacttgcaaagctggacaccacccagttccagcacaccctgggttttttgccaggactttactttgtcagacagaagctttattgtggaccttacttgtttctaatctaaattgattgctgtggggacaggacaggacagcctttagcagatatccctgatgggagcctttcagctaggggccagcatttctccagagcctgtggggttttggtgcacacatggcacagaaatagtgagcctgaacagcctgccttcctctgagcttcagctctggaaggctctgggacaaaactaagcaattaacttgctgtgggccctggctgtttagagactaatattagagtgtctgactttgatgtttgcctaggagagctggactgctctcaggattattgtgagacctcagaacagtgaggtgtgcagggccctcagcagcctagtacctgatgaggcctgtcactgtgcctctactggggatgcctggagcaggattgaagagccccgaagtgccccccagcccccccaagcgcgcgtttaccatgggtctgactcttggcccagtccctgtgtgtcgactctgtggatgtgcttggagggagatgtggtactgattttagatgagacctgatgctctgagttcacatcctcatgtcctcacactacattaaagcaggcctaggggcttttttttttcccagtaacttcaagtggagtctgtgacaagtgtacctagcctttcagagcctgaacacataggcatgtggacatataggtaaagggaaactgagtcacagctttcattggaggagcagtatgctcttgtctgtgactgtgaggcacaccttatgtcacaacatagagtactaactgtgcaggtggactaggaacttctttttttctgagacaaggtctcaagtagcccaggctgctctgcacttgcttcatatctataagtgattctcctgcatcaacctccttagcaacggagtgacacatgtgccacttcacctggtgattgggaggctttaatgcagtggttctcaacctttctcaggctgcgactctttaataccgttcctcatgtggtgacccccagccataacattattttcattgctactttatgattttgctactgttaggaatttttggggggaggggagagtttcgagacagggtttctctgtgtagccctggctgtcctggaactcactttgtagaccaggctgacctcgaactcagaaatctgcctgcctctgcctcccgagtgctgggattaaaggtgtgcgccaccacttccagcactgttaggaattttaatatgaatatctgatatgtgacccctatgaaagggtcattcaatccccaagggggtccagacccacaggttgagtaccactgctttagacacaccctagttcattagctttaaggtaacttaatgatacacaacactgagagctgtggtagtactaggggaatttggttcttggcatcaatgtgtttcagagacataccatgtactcatcatttgtaagtgtctgtatcaggtacatggggacctcagataaacaagaatttgaaggagttaggaatgtcctcaaatgaagagaaatacatataggcacctgtgactaggactcacctagtccctgtgatactgcacaggcagcaggtatttacctcatcagaatttgactaaaatactgagtaagttatgggttttagtttttcgatcttctccaacttggaatatacagattaagagcaaaaaatacggggcgagagagacagctcagtggtcaagagtacctgctgatttttgaaagggcctggatttggttcccaccacccacagtcttccacaactctggttcctccattgccctcttctggactccgacagcactaggcacatctatagtacacttggcatatatatgcaggcaagctggttgtgttggcacatgctcttaagtatagcaaagaatggtagatctctgagtttgaggctagcttggtttgttgcaaggacagccagggctccatagtgagggcctgtctccaaagacaaaacatacatttacgccagtcatacatacaaaataggaaaaacattcaaataatttaaaatgtgacaatatagggaaatcaggcttagggttataaacttgtatatatttcaaagtctggagttgggaggctctcagtggggttaagtgtcttatgttggttttggtcatgcagggaatggtgtggtttcctacagtttctgttggtattgtgtagctgggaaagactgtcgatgcctggagggcctcactcattttttaaaaactgcagatggagaggcagggatgttcattgtattccacagctatgaatgaggtgtggttgttcaggcatgcacctgtaagccaagatggcctcgcttttagtcctgaccccaactcttagaggcattgagatttttgacacagctcttgtctaatctgtgtcttgaaatgggtcagtaagagccttgcaggactttcaggcttgtgataaagatgaatgagtgagttccctttcccatcaccctagtgtagcacctacccatcatggatctgtactttgatcttcatcccaggggcagatgttgcttttccagccatcagagcatcctctagtcccttgagtgtctacctgtttgataaaccagtatagttacaagaaaacttgggattgctcagattgctgtcagctggccagaagtccgggtaacattgctgctctggagctgcatgaggttgagatgccccccttatgggtatagcggacacagttatcctttccaagggtcccatggtcagccacaggagctgtgtgtgctgtgtatagttagtcatagaaggtctagaagcaggcaggcagatagcctctttcccaccccagttgtgatttgttaccagagcattgtcactaggggtggaagtaaactaattccttcattttgtttcccaaagtgaaggccttggagtctttcagcaatcttctaaacacagtctgtttgattcatgtaagatgtcgcgtggagggccgttcacagaggacaaagtggaagacgtgaaagccctggtcaagattgtgcccgtgttcttggctctgattccttactggacagtgtatttccaagtgagtgctgacccagccttgtggctgatgttgcggtgcagggctcagggttgtccatcagttgccatagttttcagtcatggactcaggttggctgctttgtgttacaaaacctttcccaagaagcagctgagaattggtggtgtgcttctggttttctggaccctccggcttctttgtcatttgggtgcctggaagcttttctcaaagagactgtatagtgtgactcaataatttccatgtctgattctgagaggagttgccacgcctcagctacaggagggagggtgtgtgcacagacttggagaggccctgctggcttacctgcaccgttgctttctttatccagatgcagaccacatatgctttacagagtcttcatttgaagattccagaaatctcaagtatcaccaccacccatcacacggtaagagacctagaggtggcagctgcatcaggtagctgtgacactgtcactagaactagttcctgcttagttacagcctgctgagattggattggccagtgccactaaacactagtactgtcagactcagccctctcccagctctgagcacacttattgccagacagcatctccagttgaagcatcttggtgtcatgcattgtggtgggggaagtgctgtaccttagctaatgccatgctctgtgcagctgcctgcagcttggctcaccatgtttgatgcggtgctcatcctcctgctcatcccactgaaggacaagctagtggacccggtgctgaggagacatggcctgctcccatcctccctgaagaggattgctgtggggatgttcttcgtcatgtgctctgcctttgctgcaggtgagccaccatgtctctggccccctcttctcctctctctcccagagtggcttctgcagcatgcagaagctagtgtattgttctgaaggcactgggtagctggtgactcttcaagtgccattttcttctcgaggacaaaccttcatcctagggctgaatagacttggccctgcgcaggccaacactcagtgtggagtgggaatgacaggaggagattctgtgaaagcttcacagttggtgaagccaccagtgtcccagcacggagaaaaagggtttgtgggattgttctaggctcctgggacactcccagcaaaagtcttaacagctgaagagctagctcctcaggtcccatgccacagtccagcgtgggacagtgtcctaagactctcctctttccctcattctttctgtttgctgatgaggctggggtctgtgtaccttttcaggagcatcaggtgctcttaactgctgagtcatcatctcagccccactttcttgtttaatgttgaaagaatagtaatgccaaggatttgcctgtcgctacaactgtaccatgtttattatgcttacggaagggttcccactccccttttattactttaaaatttttattttgtatgcatatgggggaggaggtgcgcagaccacagcacacgtgtggagatcagaggtcagcttgcctgagttctccccttccaccatgtcggttatagagataaagcctaggtcatcagacgtggtggcagcaccttccccctttgattgaactgtctcactgggctagaacgttgatttctacttgatctgaaagtcacttggggcttttagcattttgctttagtacttaggtttgtgtttgtggttttgtagagttggggaagatcctgtgttgggggcttggtagtttcttgttatcgtggcatggtggcgccagcttggtactgaaggttccagtgtactgtctcccaggtcccctttcatgcttctgctatgctgtccatctcctgggcctcagcattctgtgctttattttggttctgcccacagcctcgaatttattttcttgaactgaggcaagtttttgagctttgtctagagacttgggcccatttatttcaaggactgcacattgggtaattcagaattttcttttcgtttatatgcctgtggcggtgtctttggggacttgggttgcttacaggagcatgggtaacttggcagcggccaggccattcaggaagtatctcactctcctccagtgatcattagttacacagatctcacgcctcctctcagttttaaaaagatggggtgctggagagatggctcagtggttaaggtcactcacctgctgctcttgctgaggtcctaagttcaattcccagcaaccacacggtagttcccaaccatctataatggagcattcgtgcataaaataataaatcttaaaaagatgaacaggatgagtagcccagacacttgagggtgaaactgatcatagtgaatatctgtaaaatgcctggtgaagatgacaccagctggatgacatgactgggatctgcctaggaagttgtcatggtcaccctcctttctggatcgttgataaattcctgtaatacactgcagacttagattaatgtcagctttaagtgctacactaacttgattcttaattttaggaatcctggagagtaaaaggctggacctggtaaaggagaagaccattaaccagaccattggtggtgtggtgtaccatgctgctgacttgcccatctggtggcagatcccacagtatgtgctcattggcatcagtgagatatttgcaagtatagcaggtgagactgtgaatctgggcctgtttgtattataccctgcactgagctgagcaagaccatggtgctttgtgtgggagagtgggggtgggggaattgtctcttaaagcatgacccagtaaatagtagtcctcaggctaaggctgccctttcttgtgcaaaaccagtgttaagatattttcacaagtccatcatgacccgccctgtgtgtcccaaactttgcagagcacagctgtgctgctggtgcaggcttacatacgtgaaagagcaaacctgacttacagagcttgttctcattagtgataccctgcggggacaaggcttagggcaggttgtctcttgtagcagtgggaagagaggaggcgcatgctgccgccttccaaaccctggcagatttctgtgactactgatgatgggctttgctttagctttgccccacctggtcactgtgactataagtttataggtacttgaacctgttatgctgtgttagctgtgaagtaggatccttttagaggcctctctctaaccccattcaagtcttgacttttctttttttttttttttaatttatttattgattatatgtaagtacactgtagctgtcttcagacactccagaagagggagtcagatctcgttacggatggttgtgagccaccatgtggttgctgggatttgaactccggacctttggaagagcagtcgggtgctcttacccactgagccatcttaccagctctcaagtcttgactaaaagatttgttcattttatgtgttgcctgcgtgtatactgcatgcatacaagtctccatggaggatagaagagggtatcagatctcttagaactggagttacacatggttgtgagcctccatgagggttctgggaatagaaccctggtcctttgcaagagcatccagtgctcttaaatactgagctctctctccagccccctgagattttgagaaaggattgaacactgcagcaatcctctggctaccgcctgttgaattctagaatttcaggtgtgagacaccatgtctgtcttgtgacagaacttacgaatatcttacaagtgagagtgccacttttccttgacgtgtttaaagagctctcatgaggatgagtggctacacccaatgctgacttctccaaccacgtgtgtttccaaggacagtcctcctgatagtgctcacaccccagtgggatccatgcatactgggaagctggctcagggtgacatagatgatcttctaagagtgacctccttttctctaggtctggaatttgcatactcagctgcccccaagtccatgcagagcgccatcatgggactcttcttcttcttctctggcattgggtcctttgtgggctcaggactgttggccctggtgtctctcaaggccattgggtggatgagcagtcatacagattttggtgagatttgatgtctggaggggtgggaaaccagagtgcttgctgtgggttgtgtgaaaattcagtctgtcccaagaggcctctagcccaacccctgctgaatctagcttagcacttcctgagagctgggtgagaagcgagacctgcgtgtcagcctgctcttaatgttttggttcctgactgtgctgggtttcagattttggaagggtgggtagtgctttgtcagtgaacactgctgctcctggaggaggcttctggttgttgatctgggcagctctgcagtgctgtgtgtgatccagggactacaacatcctttgccttttagataagtacatgttccctatgcagaagtctgtactgtgagcatttgcgcagcttggtggcatttaatctgcttttattgcatagctttgggaaagtcaggaatttttttctagaaattgtgggattcccagggccttgaattggattcctttgaatcttggggtaatgctcagaagcccgaaacccccttccccaacctctctgggtgcctataactgactgtgtagctgtatgaggccaggtgtcaagccaaccagctgtcctggagcttgcccttgctctcatccccctgggacagtgacattcctggagtagagtcagcctgcatgatgcagacttttccaaatggtcatcacaggattctagttattagtttaaaacatttactattatatatgcaagtaatacaggcatgtgtggaagacagctttcagaagtcatgtgtctccttttcctgtgggatctggggatcaaactcaggctgtagggcttgcatggcaagtgtctttaattgctgagctattctaccagtccacaatcagggactcactctgtagcccagggttgccttaaagtgcaggagtgccattcctacttaggagaaagttgtcagaagagattgcaacctcatgaggactctagctcacctagaggacactacatcaacccttaccacctcacatgtgagtgcgctagttctgggattgtaggtgtgagtgacctcactggcttaggctctacacacgttctgtgtgtgcagagttggctgcttttgcttattcccactctcagtctgctccctacctcaatttactaatttagtcttagagtttttcagggagatcaaagacggggtttttctctctctatagcttttgctgtcctggagctcattctatagaccaggctggccttgatctcacaaaggtctgcctcccaagtgctgggataaaaggcatgagccaccgccgccaccaccaccaggtataatttagtgtcttcttgttcccagctgtttctgataggctgtacctaagcctctgcagagttcctttgattgctgtatagccagtgtgtgtttaaggtagtgctttgcagtgcccagcagcttctcactttttgttagggactggggtcagtgctgtgcaaaggccctggtgtaacctggtctctttagaaggaacaggagctccaggccagcaccccttcttcccaccaggtgcacagcacccttccctccccattccatgtcagcatccttgcagacgaggaagtgaccagcgcttatgtggtgtccctggtgggctaggggttcctcgtgaggtttcagggctccctaggcctccattgcacactttcttgtaccctagccccttccaacacttgccactgttccctatgtgggaataacactcctgcagcccagtgctgtctaagccctcagtctccatgctgctagtacaggtcagtgcagaatcctgtcctatctcctctctttgagcaccctgccctggccaggacacattctgttcttatagagtcaccatgggactctcatttcttctgagaggctccctgttgatctggagtgtcattcccccacagaattatatttcagtgtttcttgggtggtggatacatatttgaattttttgcatattcccaaatgaggctagacctggtaagctgtagtgtgctttcttctctgggggccagtggtatgtacataactacacagtccacttgtcttgccagcttcaccactgcacataagattataccactggtaccttttcacagttgcagacaggttctggaagatggctgtgtcactgaccacgagggagcaggacagagcaagggcaaagctgttttccatttcctgactgaatcagtcttttgtctgtgaggttcaggataacaggactcttcccctttggggcagacttagaggttttgtccttctctgtggatcatgtgtctgtgcttgttgggaccctgtgttgtgcttgcccgtgttgcttgatagacatttgatactcagagcatctgctcaggtagtaaagggtgtttaaaataacccagcataaaaggacattaggaggaacaagtcttaccttctcagtagagactggaacatgcttttgaagtgtcagaaagtgcaacaacctccagccacagcatgagctgtgcgccagttcccttttgtatgatgagtcacctggagtatagctgacgtgctcctcggcagcccctgagagctatgaatgagacctgtggagactcattatggggacaggaggcaccctcagtgctcctttcatgctgtgcccagctgtcatcctgccaccggcatgtatgttggtcctggatctttgtagtagtcctggagcggtggtttacagaagtgatagtgtgaggtgggcagcattacagctaaagctgctttacacaggcccaagtcctcacaggcgcagagtcacagtggagaccacaggctccaaccttgcgacctggctgtgggagctccacagtctatggccctgacctgcacctgcctccttcctctggagtttgggtgctataaaagctgtgacactacttttatggtgagaccaaggtgtgtgcattataacagggagggctgcctatatagatatgcaaaactcgaaagatgctaaggaaaagcatctagcttactctagagcagtagttctcaacctgtggggtgacctttagggtcacatgtcagagatttacattatgatccataacagcaaaattatagttatgaaatagcaatgaaaatgattttatagttggggttgcagcattaggaaggctgagaatcaccgctttggtgggacgatatctcctcatgctacctgtcatgtgggaaggcccacaaattggggaccgtgctagatacagtcagtcccctgcagcattgctgagaggaatgtggtgtgggctttattcatcctcagaagtgtcactcagtgctaagtgtaggcagtgataggagagcgcctcagagagaggcaggaagcagcacaggaagcttctctcatgtctgtgtggaggagaaaatgcaagtcaggagcatcgctgagaggcctgaggtgacacccagcctcacaagccttcctccgagtcagagctagggctgggacacctgccttctcaccttcctcccaccaaggatgggagaggccggtggctagtgcccattgccctctcaggtggccaagagccagtgagaaggtgccctgtctgtggagtgctcaccaggaggtgtctgctcgctcctagggaacatcaacagctgccacctgcattactacttcttcctgctggccgccatccagggagctacgctgctgctcttcctcattgtgtctgtgaagtacgaccgccagcgagccaggacagatggggggccagccagcacgaggacctgatgcagccagccagcatgctcacaggttctgcagactctaaggcctcagggcttgctaactaccagggcactgccagcaagcagactgaggctagattgttggtgtcccaacttctgaacttgcatgttgtctggactggcttctccctccctatgcccggatgatggtggtgagtgccttactatggcccgtctcatgtgcactgggcctgccaggagatgaggatgtggcttctctcactgaaggtctctgccagtcctgagccagccgtgctctcctgggcagccaccgttctgctgctgccatccttattccttacaaatattgttacttcctcatagcatctcctttacgattagcaagcacttccatcaaggcataggaggattctctttagaggtgaaagtgtggttgatgtcaagagagccctaggagctgtgtctactccatcatggactcttgtcacaggcctggctgatgccaaggcctttgtgggtcagtcatgtaggctcatctgctcagaaagtaggttttgttgactgagataaagaagtttttattagactaggctggcctcaaacttggggctgcctcatgtctgcttctcaagtgctgagatctcagatgtctgtcactatggtcagcaggacttaggtcatgaacaactgatctgctttaagcacatgtgtccgtggtgattgaggacaccatgtcctcactgaaaccagacagcagctggcaggagattggcagttacaccacgcagatcttttctgagaacttgactttgtgtagcagtaaggatggaggcaggtggtgagtggggaaaacatgggagctgctgggctattggcccagctttgtaccgttactgacatctggggttctgagtttgtcaactgaactgttgtgtgtgttgctgtgttttgtataattttataaaagcttctcagactgacaccaagagcttcctgatggtttctccatactctgcatcagttcagcatcccctacagctgctgcctgctcagccttgtgttcctttggcccagtgttagagccacagtgttcaagtccacttctgccagaaacctgactctgcctctctcacacaccaggaagaaagaagcttcaggataaaaaccatccactgtgccccttgttcttggctttggggcaggttgggggggatagttctgcagaggtttgcccatatcttaaagaagaagctggatgctgaagtcattaatctgctgtcacgacgtagactttcctgggttggtgagaaggcctagcaggtaaaggtgcctgtccccaagcctgaggctggcagacatggagggaaggaaccagttgtcctgacctctacattacaccattatgatgtgcaaccttccaccccaagtaaaacatattctaaaagtaggttttcttcacaggaatttctgtatttgcatgagagaaggacctctgccaccccttagtgtgctgaggacacacagggtgtgtgctggtcataggcatttctgctttgatagcccagggagcaccctaagtgagacaagaatggcagctgggcaagagactctggtgtgatgaaaaggacctgtgggaactgtctcgaaggtcctggggctgagtgtggcgagagcatccatcatcctaatgagactacatagtggggttggcttcagtaccagccatgctcagtgagtggcacctccacctggagaaatgcagcagctattggtggaagttcactctactcatgtctccatagcacccacaggatggtacctggtactgagcagactgaatggctttctcttgccatgtcttccatgtctgttggggttcctttagatgcccacatttgagaatgatcttgcatgttagtcaaacctgggaaagactggtgggtaccagattcacctccagtctgtgttgtgggagatctatttgtggctgagctggtgttagtcctaaagccttgacattagcatctgaacagacagaccataggcagtcactctgatctacagttctaagctggcagttgaataaaacacaccaaactgagctgtgctgtttggggtgtttcaagctgtgtatgccctgagttcttggctgtgttacctcaactgttctttgtggagacagactagcttcttcagggttatgtgtgtcctcatatcctgaggcagaagctgagattcgttttgtttgtttgttttgttttttcttcaagatatgatttctctgtgtagctataactctggctgttctggaatttaatctgtagaccaggctggacttgaactcagatccatttgcctctgcctcccaattgctggaattaaggcatgcgccatcaccgcctggcaacagatctttataaaaccagcttcttccaaggtacttggtccctcagggttgcagttgctggtacttgagtaggtcatggccctatgtccgctttcagtttgctagaaagctccacatatgcagagctccagagcacgtcatgttactcatggtgatgcatctgtgctgtggatgctgtaagcatcttatatggattctcacaaagaacaaatcacttgtgtggctattttagtgttaaaatcgaatatcttgttctttgcaaatagggtattttaaagggaataatacacataggtggtgtgctgaataaaaacatcaaattacaaaagagaaggcagatgataccaagctgggtctgtagattatactcctctccaagttaccacacagttagggtctgagagagtccaggaccacatctctcatctgctttactgactcttctccaagccaacttactgtgaaagacagctctgatctaaggtaagtagcctgactaccagaccctgtggtaacaggctatgccacagcaccaaaggctaaggtccatgggagctacgtttgcctttttgtgcccactgtctggccatgtgaacactgaagggagtgaacggcagccaccactcgggccccaggactgtgatagggatggtttttccagaccttgtccctagctctgccctcgccaatcatgtcaacacatgtcaatcccccagcccgtgggtcgtttgtttctaattttttctctagaactcagacctaaatttctaaaagatgtctcctacctggtcataatgatgtataagtaagtgtatttagattcttctgagaagggtttatcttctctcaggcagaagggcctgggtgctcatccttcagtgatctctcagtatccagcacattttgctactgacatgtagagtcctgggcagaggttgcagcagctagaggagagccagaaaaggcactggtagtttgaatgagcgtggttccatagggtctcctgcaagaacaacaaatgggaaaagaacagagaatggagccactgaaatgactcgcacatctgataccacgtgaccacgatgtgggaattctgcttttttcttccatcccaagtaaaagagggttggatcctgtgtgttcctagcaacagcaccattgctcagaccgtctgtaatttccagggggatctgactccctcttctggcctccatgggaactgtatgcatgtggtacatagacatgcaggcaaaataactatcataagtttaaaaagtcaccaaatcttggcatcgggaacatttaggcagattcgagtcttgctcttccaacagtaatgctgtacagggccaggacagcagccagagactctctatttctaagcaaggtcatcttgagcttctatgtgtacttgaactttcagggttggagcattttacacttaaaaaaatgcagccttctgaagactttgggaaattggtcaaggtgactcccaggggcctaaaaagaaaggagctgggttgactcacgaccttacccttgacaggaatctcatgtgccttgcttgctgttttaactgtttaacagctggtgagtgacaggtgtcagtcgttggcagagtagtgagaagctgcccccaaatggacactcagtgtagagcagaactggctgagactgagaacccggcagcaagccgacccttgactcatctccctccagagtctgcctaatgaaaggcctccctcaggtcagcacagataccaccacgactttctctgtttggggcaaacaactcatagtcatttatatcactccaatcaagcaaaaatgacatttcacactcagtcagcaatgactggaaagctcatccagaagaccccacttagtgtggtctcatcttgtctgtccctgttccctgtgagtgatacggtccaagggctgagatcagagagccagctcagtgacttcgaacagcagggatgaaatactatgagcacagtgtggcaaatgctatggctaccagctgtgcacaggacaggagctcatactgcctatgtggctgtagcagaaagagcccgagagtggctgaaggaagctgactcaccatggtaggtctggttctagaaaattccaagtaagacaggaccccctcactggctttgaccagactggtttgatctggctgaggttagatccccccccccccccccgtgggccgaaaagggaatctaaaatgtggggatagactgcagagtgaagcagtgcagttgtgggtgcttgtgccatgtctgaagggagcctgcacccccagagcatggcctgctcaccaacccggacagagctcagaagaattcagtgggacccccaccctcggggtgggggtggggtggggtatgtgcaatagagcagggactcagtgcttagtctgaggaggtgggaatttctccgccccaggtaaaacacttggtttgactgtccaaaggaagatgccttcaaaaggaagagctttgaaaataagttagaatcttacagaagcaactgccaattataaatgatagaaaagttactagcaatctcagagtgggttttttttggggggggggtcccctctgtagcccagagtagcctttaactttgtagcagttatgcttctgccttcaagaactatacccagggctggtgagatggctcagcggataagagcacctgactgctcttccgaaggtccggagttcaagtcccagcaaccacatggtggctcacaaccatctgtaacaagatctgacaccctcttctggagtgtctgaagacagctacagtgtacttacatataataaataaataaataaataaataaataaataagtaaataaataagtaaataaaaaagaactatacccagctgtctatatttttattggttattttatttatttatatttcaaatgtccccttccacaatccccctagtacccctccccttcttggtctctgaagagagtgttcctccacccagtttgagtcagaggattactctagtccagactctccaggagtgcttgctaggtaggtagcctaggatggcctctagtggcagccctattctttcaaactcccccaacttcaggaatatgggcaagagcaattatgtcttgtccatacctgctgagtgtatattttttttaccttctcccccacccccctttgggttgcctggagcttttaatgtaaactagcctcaaactcagatagttctgctgcctctgtcacctgagtggaccactacattcagctacttattttgtatatgcacacttgtgtgtgcttacatgtacaacatatgtgcagtgcaacatatgtgcagtgtccccatggaggctaaaagatggcatcagatcctctggatctggagtcacaggtggttgtcacaggtggttgtgagccaccatgtggatactgagaactgaacccaggtcctctgcaagagcagccgatgctcttaactgctgagcttctctcagtctcccctccaacccccttaagtgtgtgtatgggtggttttcctgcatgcccgtctgtataccacgtgcatacagtgccctaggggccagaaggaggtgcttgggcttaacaagcagttgtaagcggtcatgtgagtattggaagttaaaatccttctccactgagccatcgctccagtcccatacctattaataatgtaagaagtaacaaatctactctatgactttggtggagccatagaacccattcaaaagacgttttcaaaaataaacatttgaataaaatctgtacatgttatactgatgttatcattgtcatcaaaatgttaatttttatattgatgtcatatttatgtaaatttgtgtttttacaggtccgaagcaggctagtttacccttggtgtgcatgtgtcttctcattatttccacacttgtctgactataatagtgcaccactgctgtttgtataaagaacagtttggcacaagcctctaatctgtagatctctgagattgagtcctgcctgatctacagaattacaggacagccaggcctacacagaaaatccctttcttgaaagtttgggacactagagagactgctcagagatgaagcatgtgtgtttctccttcagaggacctaagttgttcccaacacccacatttgatggctcacaactgcctgtaatagccactggtttaggtgcaggttcatgtacacacacacacacacacacacacacacacacacacacagtttttatatgtaaattcctcccccccccccccaactccacaaatcactcttagcaaagcctgtcgggcccattgcctctctgtgggctacagcagaattgcaagccatcttagccctgtccattctgacatagactatgaatgtatctagttaaatataggaaacctgcccaaagcctcttgttgtaggattcaaagcaggatcccgtgatgtcaaaaataaatctcacccattgctttgctggagtgcgtatccccaccccgaactgtgcacactccctctctttctcttgtgagtgcatgcagacacatgcacacacacacattaacaattgcaatctgctaaaagcttctgacgtgcagggttcctgaagaaccattgtctggataacctgattaaaattcccatctgactgagcagaaacagtatgacctccatttccaaaaattcattcagtcctatgtagagcacttagagtcacacaatagttcttccaagactacagttctgaaatctgattgaataaaggcaccaaacaaaaggagcacactggtttaaatattttttttttgaagttttgacatagagctaaaaatctgtggtgaaagtaacaggcgttctgcatgtacacccaaaggttctgggctaggttgctatttattcattaccatgtaatggatacccaagtagtttagcaccttagaagcacacacacacttagaaccccttctgtgggctggagacacactgtgtagacttgggagttagatcacattgctcactgtgtctggtttccctgcaaagaggttgttctccaggcttctgccttagaggtggggggttggaaagacacagcaagaggaggagaaatagacaattgggcatggagaagtggcccagaggttaagagcactccttgttcttgtagaggatcaaggtttaattctcagtatctccatggtggctcacaatcatctataagttcagatgcaggggatctgatgccctctccggattatgtgggtatctgcccatgtggcatacgctcatatacttctacataaaaataaatcttattagctggagagatgacttatctgtttaagagcactgactgctcttccaaaggacctgggttcaatttccagcacccacatggcagctcacagctatctgtacttccagttgcagggggtcggacatcctcacagaggtatatgcaggcaaaacaccagtgtaaatacagtaaaaataaatctttttaaaagttaaaaaattgacctttcttactctctagccctcctctctttcccttcccccctctctccacatggtcatggcaggtctctatctcctattttctctcttttccactgcctttctacaataaagctctaaaaccataaaaaaaaaaaaaagccttaaaaaattgtgttcatgttactgaaaaaccaaaataagtatctttagtattgattttaaaaaaaagtgtccagtcatatttacaacaatgccagcgatttcaaattcaatggaacagcatttcaaaagtcacattttgattttatgaattgagtaaattataattctgtaatacctgatgttgtattcaaagcacaaatataaaagtcagtgcgctaacaaaggcagtgcttctgtctcccctcaagataaggaatcaactggctgtggtgagcacacctgtggttccaccactcagggaggagaggcaggaggattgcagtaagttcacggttaatttggaccacacagtgagtttcaaaccagactggagtttagtgtgacgtcctgtcataaaactctaaataggcgctggagaggtggcttggcagttaagagcttgctgctcttggagaggatcttgagttcaattcccagtgctcaacctaccaggaatcagatgccctcttctggcttttttgagtacttcatgcacacacgttataagataaaaattagaagaaggtgtgatccaaagacgccgtgatacccacaatcacttctggaataatccaggctaggcccccattgccattaaaagaaaaaaaaaaaatcactgacttccagtttgcaaatgactcctattttgtgtagattcttctttgagtcaggatcatatgtagtagccaaggctagcctcaaacttggaggatgcccctgaacttctgattccattgacttcgtgtcctgagtgctgggatcacaagcatgtaccaccacaccatgtttatgcagtgctggggatcccaggcacctctgtcaactgagccacagccacaggtcccaacttacttgcttttgcaccgtctttgtttctgtcaaggcacacagaagcccctcattgagactgagcactgtagataacttcttatccccagaactgttttctgtggctctctcagttaaggtcacacacatggccttcactggctgacactgactttatcctcaggctttcaggacatacatgatacttctcatgacttcattttctgttcccctccagcagtgtgttctctcctggcatcttcaaagagttgtcgaagtgaccgcccagtgccttggtttaggatcttgatgggccctcaaaagtgcatatggatgtcagcctcaattgttcttgggtagtggtgaaatcttcaggaggcaaggcctagggacaggaagctatgtcactgaggtttgcccttggagaggtactggaatctgagtcctctctgcttcccagaaatcatctgagcaatttttcccaaagggacctaaaagaaactttcagacttcaagtgctttgtcacagtgactaacagcaaactaacagctgggcttctcacatcctccatatttggtagaaaagccagcatatctttcattgagggacttttgcaaaggcccggaacttgatgggatggatctgtgagccactagttctcgtccagccctatgctgcctggcttgtgctggatctcgcagctcccaagtttgaagatccttctaattttcccacccactccatcgggatgcatcatcctgggctatttgtgttttgttttactcctctcaaaatattgactctggaagcagcagacactggcatatccttcagaggtttctttgtttgtctttaaattacatcagctgaagagagccccaaaggagagcacatgttttgttggaaatataaagattgaaaacaggaagagatggacattgagggacaggttcctttgtctgctgggcatttctcaggggacggaggaaagggagactcaattttgagtatacacaaggggtctgcatgggatgcagtgtggctctctggcccttcccactcaagtgggtttgaataaataagagaagatggatttgtaatggaaaaagttttctttcagagagattaggaaacaatagccccagtgctgaggaagaagggcagttgatgggatacaagcttcacctgctcccgatttgcactgattgaataacaacccccgattgttcttgcccagtgacagtgggtggtattcgttaccccaggaagcagcagaagatggtgggtataggctcatttgcatgttgctgtggttcagatatgaagtccccacagactgactggtgggtttaaacacttggtctccagctaatggcaccttttggggagactgcaggacctttggagtgttggggtggggctggcttgacagtgggagctgggctctaccttcagtgcctctgtccacttctggtgtgtccatgtatcaggtagctgccacacacccaccccattccatgaagctgcccatcttcagcccctctgtgagagcatgaatcatctgacaaactcactccaggattgtgacagattatttagcctctgggcatgtctatgggtgacgctcttgattagagtgaaggcccatccactttgggtggcaccattccctaggctgagagcctggattttatagaaagaagaaagttggtgtgtaagatggtacagtggttaagagcacttgctctcgaagagaacccaaatttggttctctacacccacatgtcagctaaccaccacctgtaactccaattttggggaatctgaggctttcttctggttttcatgggtggtaccatggatacacatattgcaaatacattcagggaaacactgacacaaaattaaacaaacctttaaaacaagtatctatctagctgagtgcaagcattcagcattctctgctcccagatctgaccagcttcttcaattccctcaatgtgacttaactgcagttatggactgcagtctgggactgggaaccacaataaactcttccttccttaaattactctggctattttatcagaactccaggaagaaagatcatgacactttcccaatatgacgtagagcctagcaggtgacacatggggaccgtgtgactgcaaagtcaccaaagtgttcttttgatggcctgttccagcccttaacaactaactatatgaaaaagcaaatccacagtgagatcccatttcaccctagctggaagagctaagggctatcaagaaaacaataaatgctgttgagtgtgtggaaacaaggccccttatgtactgccggaggaatctgctggggaagttggtctggatttctttgcaaagaaactaaagtagatttggagtttgctgatgagatagcttcaagtgcttgaagcaggacactctgcccttatgagggatggg

SEQ ID NO: 54 - DNA, 3192 bp, Mus musculus
aactcgctgtctcgcgagagttgggctaccgagtcctcagtgaaccggccatggagggcgagcgggcgccgctgttgggttcgcggcgtccggcagtgtcggcggcgtccgcggtgttcgcggggcggcgtgcggcgtgcggggcggtgctgttggccgagctgctggagcgcgcggccttctacggcgtcacggccaacctggtgctgttcctgaatggcgcgccgttcgactgggagggcgcgcaggccagccaggcgctgctgctcttcatgggcctcacctatctgggctcgccgttcgggggctggctcgccgacgcccgcctcggccgggcccgcgccatcctgctcagcctggccctctacctgctgggcctgctggccttcccgctgctggccgcgccccgctcgcgctccttcctctgcggggacccgcggcccgagctcgtgcgcaactgctcggcgcccttccccaacgggtcagcgtcgtgtcccgagaacgccgcgcgccgctgtgcccccgccaccttcgcggggctcgtgctcgtgggtctcggggtggccacggtcaaggccaacatcacgcccttcggcgccgatcaggttaaagatcgaggtccagaagccactcggagatttttcaattggttttactggagcattaatttgggagcaatcctgtcattaggaggtattgcctatattcagcagaatgtgagctttttcacaggctacctgattcccacagtctgtgtggccattgctttcctggtcttcctctgtggccagagtgtcttcatcaccaagcctcctgacggcagtgccttcactgacatgttcagaattctgacctacagttgctgctcccagagaggagggcagcggagaagtggtgaaggccttggagtctttcagcaatcttctaaacacagtctgtttgattcatgtaagatgtcgcgtggagggccgttcacagaggacaaagtggaagacgtgaaagccctggtcaagattgtgcccgtgttcttggctctgattccttactggacagtgtatttccaaatgcagaccacatatgctttacagagtcttcatttgaagattccagaaatctcaagtatcaccaccacccatcacacgctgcctgcagcttggctcaccatgtttgatgcggtgctcatcctcctgctcatcccactgaaggacaagctagtggacccggtgctgaggagacatggcctgctcccatcctccctgaagaggattgctgtggggatgttcttcgtcatgtgctctgcctttgctgcaggaatcctggagagtaaaaggctggacctggtaaaggagaagaccattaaccagaccattggtggtgtggtgtaccatgctgctgacttgcccatctggtggcagatcccacagtatgtgctcattggcatcagtgagatatttgcaagtatagcaggtctggaatttgcatactcagctgcccccaagtccatgcagagcgccatcatgggactcttcttcttcttctctggcattgggtcctttgtgggctcaggactgttggccctggtgtctctcaaggccattgggtggatgagcagtcatacagattttgggaacatcaacagctgccacctgcattactacttcttcctgctggccgccatccagggagctacgctgctgctcttcctcattgtgtctgtgaagtacgaccgccagcgagccaggacagatggggggccagccagcacgaggacctgatgcagccagccagcatgctcacaggttctgcagactctaaggcctcagggcttgctaactaccagggcactgccagcaagcagactgaggctagattgttggtgtcccaacttctgaacttgcatgttgtctggactggcttctccctccctatgcccggatgatggtggtgagtgccttactatggcccgtctcatgtgcactgggcctgccaggagatgaggatgtggcttctctcactgaaggtctctgccagtcctgagccagccgtgctctcctgggcagccaccgttctgctgctgccatccttattccttacaaatattgttacttcctcatagcatctcctttacgattagcaagcacttccatcaaggcataggaggattctctttagaggtgaaagtgtggttgatgtcaagagagccctaggagctgtgtctactccatcatggactcttgtcacaggcctggctgatgccaaggcctttgtgggtcagtcatgtaggctcatctgctcagaaagtaggttttgttgactgagataaagaagtttttattagactaggctggcctcaaacttggggctgcctcatgtctgcttctcaagtgctgagatctcagatgtctgtcactatggtcagcaggacttaggtcatgaacaactgatctgctttaagcacatgtgtccgtggtgattgaggacaccatgtcctcactgaaaccagacagcagctggcaggagattggcagttacaccacgcagatcttttctgagaacttgactttgtgtagcagtaaggatggaggcaggtggtgagtggggaaaacatgggagctgctgggctattggcccagctttgtaccgttactgacatctggggttctgagtttgtcaactgaactgttgtgtgtgttgctgtgttttgtataattttataaaagcttctcagactgacaccaagagcttcctgatggtttctccatactctgcatcagttcagcatcccctacagctgctgcctgctcagccttgtgttcctttggcccagtgttagagccacagtgttcaagtccacttctgccagaaacctgactctgcctctctcacacaccaggaagaaagaagcttcaggataaaaaccatccactgtgccccttgttcttggctttggggcaggttgggggggatagttctgcagaggtttgcccatatcttaaagaagaagctggatgctgaagtcattaatctgctgtcacgacgtagactttcctgggttggtgagaaggcctagcaggtaaaggtgcctgtccccaagcctgaggctggcagacatggagggaaggaaccagttgtcctgacctctacattacaccattatgatgtgcaaccttccaccccaagtaaaacatattc

SEQ ID NO: 55 - protein, 588 aa, Mus musculus
LAVSRELGYRVLSEPAMEGERAPLLGSRRPAVSAASAVFAGRRAACGAVLLAELLERAAFYGVTANLVLFLNGAPFDWEGAQASQALLLFMGLTYLGSPFGGWLADARLGRARAILLSLALYLLGLLAFPLLAAPRSRSFLCGDPRPELVRNCSAPFPNGSASCPENAARRCAPATFAGLVLVGLGVATVKANITPFGADQVKDRGPEATRRFFNWFYWSINLGAILSLGGIAYIQQNVSFFTGYLIPTVCVAIAFLVFLCGQSVFITKPPDGSAFTDMFRILTYSCCSQRGGQRRSGEGLGVFQQSSKHSLFDSCKMSRGGPFTEDKVEDVKALVKIVPVFLALIPYWTVYFQMQTTYALQSLHLKIPEISSITTTHHTLPAAWLTMFDAVLILLLIPLKDKLVDPVLRRHGLLPSSLKRIAVGMFFVMCSAFAAGISKRLDLVKEKTINQTIGGVVYHAADLPIWWQIPQYVLIGISEIFASIAGLEFAYSAAPKSMQSAIMGLFFFFSGIGSFVGSGLLALVSLKAIGWMSSHTDFGNINSCHLHYYFFLLAAIQGATLLLFLIVSVKYDRQRARTDGGPASTRT

SEQ ID NO: 56 - DNA, 50927 bp, Homo sapiens
  misc_feature (1)...(50927): n = A,T,C or G
tgtcacatttgcttaaccaaaaggagaatttatggactcacaattaaaatgtctaattttaaagaaaaagctacttttagctatgatcagaaccaagatctataaacagtccttttttctttttttttttttcttttgctctgttgtccaggttggagcacactggcaccatctcagctcactgcaacctttacctcccgggttcaagcgattctcctgcttcagcctctcaagtggttgagactacaggcagaccccacaattagcctggctaatttttgtattttagtagagacggggtttcaccatgttggctaggttggtcttgaactcctgacctcaggtgatccccacctgcctcagcctccaaaattctgggatttaaactgtctttttcaaacaagtgtctctctcatgtctatctccttctgggatgcttacttctctggtttcacaagatggcctctggcaactccaagcttatatttccatgatctcaaactcaacagaaaagagaatcacttcttcctgctcattcgagagtaaattctgggattagctttgaccaactaggatcacatgtccatctgtgaatcaatactttatttttgtttattcatttatttttttgagacagaatctcactctgttgcccaggctggagtgcagtggcatgaactcggcttactgcaacctccgcctccagcgttcaagcgattctcctgcctcagtctctcaggtagctgggattacaggcgcgtgccaccgtggccggctaatttttatatttttagtagagacggggttttaccatgttggccacgctggtctcgaactcctgacctcaggtgatctgcctgcctcggcctccgaaagtgctgggattacaagcgtgagccaccgtgcccggcctgaaccaagtactttagctcaatagatgggatactgctaattggataggcataggtcaactgcccactcttggactggaggggtcaagccgccagacctaaatcacagccgccagacctaaatcacagcgagcattgattagttaaggaaaatcaaggtgcagttaccagaagggagaatggatgctgaataggacccaacaatagctatcctctaaagagcctggccactcactgtgccaattttatgtgttgggtgtttatcctttgataatattctttatttatttatttatttatttatttatttatatttatttatttatttattttgagacggagtcttgctctgtcacccaggctggagtgcagtggcacaatctcagctcactgcaagctccacctcccaggttcacgccattctcctgcctcagcctcctgagttgttgggactacaggcacccgccaccatgcccggctaattttttgtatttttagtagaggcggggtttcaccatgttagtcaggatggtctcgatctcctgacctcgtgatccgcccgcctcggcctcccaaaggtgtgagccaccgcgcccggcccataatattctttataactctttataaaataagaacattaactttttgggaggctgaggcaggagaatcacttgaacccgggaggtagaggttgcagcgagccgagattgcgccactgcactccagcctgggtggcagagcaagactccatctcaaaaataaaattaaataaataaaataaaataaaggcatattatagaaagattgtcattctgtacatacttataataggataaataggactcaggaatatggagatataaaaagttctgctgaaaacagagtttatagaatgggtggcaagactctgtctcaaaaaaaaaaaaagaacattgtcttatgtacttcaatttttttcttagtttgtgtgctctcaacagcaattattattttttatacacataagttttaaatcttcatgtagtcaaactaattttttactgcatgccttctgcctttagtgttaggcttaggaaggcattttctctcgattatctatttgccaatattttctcctagtgcttttatagttttggtttcttaatatttaatccatctgaaatttatgttggtgcaaaatatgaagactgttttcccctatgtttcaacattcattccaacataatttgtttaacaatccatcctttccccatgaattgatgaattactgattctttttttttttttttttttttttgagatggaatctcgctctgtcgcccaggctggggtgcagtggcgcaattttggctcactgcaagttcggcctccagggttcatgccattctcctgcctcagcctccccagtagctgggactacaggcgcccaccaccacgcccggctaatttttagtatttttagtagatacggggtttcaccgtgttagccaggatggcctcgatctcctggcctcctgatctgcccgtctcggcctcccaaagtgctgggattacaggcgtgagccacagcacccggccccacctttttttttttggagatggagtcttgctctgttgcccaggctagagtgcagtggcgtgatcttggctcactgcaacctctgcctcccgagttcaaatgattctctcacctcagcctcctgaatagtagctgggattacaggcttgcgttaccatgccaggctaatttttgtatttttagcagaggttgggtttcaccatgttggccaagctggtctcaaattcctgacctcaggtgatctgcctgcctcggcctcccaaagtgttgggattacaggcatgagccactgcacccgaccagatccctttattatcatacactgagatttttcttttttgcttttattattattatttatttatttatttgagatggagtcttgctctcttgcccaggctgtagtgcagtggcacaatctcagctcactgcaacctccacaggttcaagcatttctccggcctcagcctactcagtagctgggattacaagcacctgccaccatgcccggctgagttttgtatttttcatagagacaggctttcaccactttggtcaggctggtctggaactcctgacctcaagtgatctgcccagcttggccttccaaagtgctgggattataggcatgagccaccataccaggcagcctttcattattattattattatttttgagactgagttgcactcttgttgcccagactggggtgcaatagtgcaatgacggcttactgcaaccttggcctcccgggttcaagagattctcctgcctcagcctccggagtagctgggattacaggcacccgccaccacgcctggctaattttttatatttttagtagagacagggtttcaccacgttgtccaggctggtcgtaaactcctgacctcaggtgatctactggccttggtctcccaaagtgctgggattacagacgtgagccaccacgcctggcctcattatttttaattgatataataattgttcataattatggggcataaggtaggattttgaaacatgtacttctatgagatcaacttttttagcttctatatatgagtgagagcacatggtatgtatctctctgtgcctggctgatttcacttcatacaatcagttattttgtattagtgcttctgttcttgttctttgtattcatcttccttgatctttcctgtaaggcctaatctagaaaacaaatacacttataattaccaacgaactattatatgattacagtttaggctaaggttgcttacaaggaattgtgaaagtggtggttaaaataggatcttaggtgtggtcacaccatcttgcgcttcttgcaatagaaggaagcagaagttcattttctttcacttactctctctctctctcttcacctccctgcttctattggcgaagcccaacttttgcacgtcttgggggttttttaaacacaggtggaaaagtacgcaagaaacagacgttgctactcgcaagggtcaaataaaatgagtgcctgaaacaagtcaaatcaaaatcagcttcctgaccgtacactctcacatcctctgttaaaataaatgcaagtcattctgggagctgaattagttcatactaaaagtagattagtgtggctttggtttaggatcaaggatttaacacctgattctattccgttggttgcctgtgtttttattgatttcactttttataccttctgcttctatcaagagtatttgtagccagaaagagtggttgcaacagtgactccttgaagtaaatagaatttatggcaactctctgtacccaaggagattcaaaagatgtgtggcatggcctgtggctgtactatggctaatgacttatgctatggcctgatgcacaaaggtgagggggcctatccgagtccctccctagggatctgggaaattggagaagctgaagcactggccgtgagtgctgaggctgagctgagctgaggctgagctgtcatgactcagggggcaggtgttcaacagttgtttgttgagtgagttagtgatgtacagatggcacagaaaggctatgacagctgcttctaacccgaagttttgaggaagctgaaactgtcagtaaggagaggcaactgtctggcggtgaggagtgagcaactcaacagagatgtgaaactacggcagaaatgtcatgaaacagccagaggagtcaggcagtcccctgaatgtcctgtctgtgacggtttctcagttcactgccttaaatcacacccactcgagctctgcactgggtgaggctcaggagacaaagtggtaccagagaagggagaaccctgtgtttccaagtctagtccacaccacaggcacctttgcaaagagtgtccttgccccttttctagagggcccttgaggtgaagagccaatagacaaaaatgttattttggaagacacggttacctatcccttagatgcctactgtatgggttgggtcatttattaattttagctgcaaaggagagactcataggatcactttttggggcagaagtatattgcgagcatatccaataaagtgggaggaatcaccttacatcaattctttagctataccatcactgggggctcagtacaggggctgcaaacccaatcattacagaagcccagcagaaaactcatgggtcaggcatgagaaaaaaatcaggctggcctctcttgttccttaatttttttattttttattttttgagacggagtctcaccctgtcgcccatgctgaatgcagtggtgcgatctcggctctctgcaacctctgcctcctgggttcaagcaattctcctgccctagccttccagttcttttattttttccatttttgatagaattatgataggtggcttggggccacaagtaatacaaataacagaaaacccaacacagtggcttaaacaatgttaagacttattatctcacttctccctgagtctcctgtgccatcccccaagtcagtctcatcctaagctggttcatctcatggttgtcaatagccatcaggagctattagagctgcaggtttcctaactcacatccagtttgggagcatgtgcctcgcccacagtcagccaataagtggccttgcctctagtctgactgggtcaacttacctcatttgtccactgctgggtcagtaaccgcaggcaccagggaaatttcgtgtcctgaaaggttagagtctgcgttcctgaactggtcaccatgaagaggcatgagactagtactggtgtgggctagttctatctgggaacaaggatgaagtcaggttctcctgagctacatgggaagctggtggggacaggggtgggttaaggaagacaaatatgtgaagagaatcaggattgtttggaaaaagaaagagtatggatgttggctaattagtcaatcatatccattacattttagtacggaatggagttgctggccgggcgtggtggctctagcctgtaatcccagcactttgggaagccaaggcaggcagatcacctgacttcaggagttcaacaccagcctggccaacatggtaaaaccccatctctataaaaaatataaaaattagctgggtatgatggcagatgcctgtaatcccagctacttggggggctgaggcgggagaagcacttgaacctgggaggtggaggtaatggtgagccgagatggcactatcgcactttagcctgggcaacagagcaagactccgtctcaaaaaaaaaaaaaaaaaaaaagaatggggttgctgatagaagttactgcaatgatggtgtgaaatagactatgctgtccaatacggtagccactagccacaaaccacttgcaatatggctagtgtaactgaggaacagaatttttcattttatttaattttaactagtttcaatagccacacatagctagtggctcctgcgctggactatgcagatatggagaattttctctatgataacaaaaataagacaatagtgagtggggagggtttaggaaagctagaaagtgtctgccatctaaagacagtggctgctgctgagtgtcagcagattgtggctacagggggaagcaaatgtgtttccattacctgttgctacataataaactgccccagaatttagtggcttaaaagaacaaccatgttatttgtttacaattctgctatctgggttgaggctcagctgtgtggttcttctgctggtcttcacatggctgcattcagtaggcaggtcatctggaatgctgagaatcccctctccacatagttgcagactcctcctcaacatatgatggaaggcaggtggacgtctaatatgatggctccggacaccccagtcatgaaagtggaaggtgtcagactttaagcctgtgcccagaccaggcccagagacacttttgatgtattctcttggtcaaaacaggtcacaggacaggccctgtggcgtgatctctgaggaatacataaaggcttgaatactatggggcatggttcaaagtgatgggatcatactaatgtaacaggtaatcacaagtccagcattgccagagctcacatttattttccccaaatagcaaggcatccaaatttatatgtgaaacctttcaaactgtaactattagttcactttcttttggtaccagctttatggagacatattcgcataccatataattcacttatataaactgtagaattcagtggttttttagtacattcacagagatgtgcaccaatcttcccctcccctcccccagtatcaggaaactgtactaatctgcattgtctgtatggatttgcctattgcctattctggccattgcatataaatgtgatcttgccagatgtggtcttggctcacttttttgtttttttaaacttagctttagttttctcaaatgaggcaatgcaatcggattagtttactatcattcaaaaatggcagagtgtattgagcactgtttggacactgggttatcacatgattcaaatcatttgctttgctttcattccatgtttaatgttaattttactctagactttgcctgagcgtcaaacctatcagtcttagaaaaaatactcaaagattctgtctcctctaccaactgcaaagtggaagcagcactggactcataattagatataagcctttcattgaagtctgagttctattgctttcttttttattttttattttgagacagtttcgctctatcacccaggctggagtgcagtggcgtgatctcggctcactgcaactccacctcccaggctcaagcgattctcctgcctgagcctcttgagtagctgggattacaggtgcgcaacactaccgcctggctaatttttgtaattttagtagagatggggtttcaccatgttggcccggctggtctttaactcctgacttcaagtgatctgcctgccttggcctcccaaagtgctgagattacaggcatgagccactgtgccactgcactccagcctgggttacaagagcgaaactccatctcaaaaagaaaaaaaaaaaatggcacatatgtgtgtgtgtgtgtctatatgtacatgttcaaggacatatattagtatccaataataagttaaaatactaatatatgcccttgaacatgtatagacacacatatatatatacacatgtatacatgcacacatatacacacacttatatacacacatatatacatatatacacacagatatacatatgtgtatacacacacatatatgagaacataaggtgacttgcatcatttacattcaacaaatggtcagtcattcactcatccagttcaatctaatacctatttatcattggcaagtgctgtgccagcctctagaactacaatcgtggttaaaacaaagatcccggccatcccagctttgaagacaggcattcaatagttgcacaaaataagtataaattataaccggtgctgtgggaaaaaagtatagggagttccaaggccataaaaacggggagctaacctagtgtggcagggttaggaaagtgatatttgagctgacagctggaaatgacaagcatcaacagacaggtggcaaaggtccaattcgggcattcaattattctctccttagacattgattaaatatatattgcctgctgtgtggcagcactgtgctgaccatcagtctatctgtcggacatttaaaaaagttttttaaaaagagaatgcatgcaacttcaagacttactggcaggattacttctccagatgacctactggcaagccaacttcccagctactggctccaccctcatcttagctggagggaatgatgaaggaagaggaggtggtcttacactaattgaatcattgcagcagctgtggatcacgattcctttctttcttgcctttttttttttttttttttgagacagggtctcactatgtcacccaggctggagtgcagtgatgccctcactgctgaatgcagcctctacctcccgggctcaagcaatcctcttgcctcagcctcccaaagtgctgagattataggcgtgagccatcatcccaggccggggtctcaatttcttttttttttgtctttttttttttttttgagacgaagtctcactctgtcaccaggccggaatgcagtggcacaatctcggctcactgcaacctctgcctccctggttcaagcgattctcctgcctcagcctcctgagtagctgggactacaggcgcctgccaccacgcccagctaatttttgtatttttagtagagacggggtttcaccatgttggccaggatggtatcgatctcttgacctcgtgatccgtccgcctcggcctcccaaagtgctgggattgtagacgtgagccaccatcccaggccggggtctcaatttctgaagccatgctgagggccatttttgggcggcactctttcactccactatgtgccaggcgctgtcccagaggcagggggcacagtgaggaacaaaacacaagagaatcctgccatcaggaagcttacacctgttaacacatgcaggttggggagataaacgaataaattaaaaaatgtaacaggtaataaggagaaaagagtaacatgatggaatgggatactcgggccttggacgggctagtgaaaaaaatgtttctctgaagtcaacacttcggtggaaggttgaaggatgagaagccagccatgcaaccatagatggtgtaggggcagtctctgggaaagcctgaaacaggctggagcttgccttgttctaagccagtgagtctcaatgggggcgtatttgcccccaggagtccttcggcaaagtctagaagacattttcggttgttaatctgaggtgctagggggtggaactggcccctagtggatagcagaggccaaagctgctgctgaacatcgtgcaacgcacaggacagtcccgtcgctcaaagtgccaacgatgcacgggttgagaaaccgggtcctctccaggactgaagcccagggcagggagcacgggggcagcctgagcaaacccgcctggagagcagccgccgtctcagtgtgagttttggctgcctactgggccccaccgaagcccgaagagggccaggctccggcttctttgtttaaactcccttagtccgactgcctgcagtggctcatgcacgtaattccaacactatgggaggctgagacgtgaggaacgcttgatgccaggagttcgagaccaacctgagcaacaaagcgagaccccatttcaaaaaactgtttaaaaattagccacaggcagcggcgagcgcctgcggtcccagctacccgggaggctgaggtgggagggccgcttgatcctgggaagctgaggctgcagtgaggcgtaaccgcatgactgcgctccagcctgggcgagagagggaaaccctgtctcaaaaaggcaaacaaaggctctcggccgccaagctgcggaatcccaagctccccaagacacgcagcgatccagaataccggccacctcctcgcctagtgcccggggcggggccggaagttccggcgagtggggcgttgagcagcggcgagcccgcccaatagggacatctcaggcccggcagtctcgcgagaagggcggcggccctgggttctgggacaggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggtgagccgcgcccccgcgcgctgtccctgtccctgtccagcccctgcccagccccagcctcttcccctgccccagtccctgcctctgaccgcggagggagccccttgccccggggggcttctgtctagtgccgaggaatcccgccagcaggtgggccaagactggaggtaccggtgtgatgggtgctggaaggggtttgcctggggcggggtgaggtctacacacacagtgatggccacagtggctttaaagaaaagagaggccgggcgcggtggctcacgcctgtaattccagcactttgggaggccgaggcgggaggatctcttgagcccaggactttgagaccaggttgggcaacacagtgagacctcatctctaccaaaatttaaaaatttgccctccgtggaggcgcacacctgtagtcctagcagagaaaggaggattccttgagcctacgagtttcggaggctgcagtgagctagggtcacaccagtgcactctagcttgggtaacagagtgagaccccacctcaaaaaaataaataaataaaatttaaaaaatacgctgagcgcagtggctcacgcctgtaatcccaacactttgggaggccgaggtgggtggatcacctaaggtcaggagttcgagaccagcctgaccagcctggctaaaaatacaaaaattagccgagcgtggtggcgggcacctgttctctcagctagtcgggaggctgaggcaggagaatcgcttgcacccgggaggcagaggtgcgatgagccgagatcgcgccactccactcctccagcctgagcgacagagcgagactctgtctccaaataaaaataaataaataaataaaaaataaatgaacgggacccttctatgttcaggccctgtaagttcagaccagaaggctaggaaagagcagttgtttgaggagctttccagacatggggattcgcaggtgcagggccctgggccaggaagctgagggaaggggaagcccccgttgttgccttagcttcctttacaaagaagtgggaaaacactcatattgcgtcttcgtggctttaaaggagttacgggctaggttgggtcggaaagctcagatgaaaatgagtttgaatcaagttagcatcaagctgctcccctgcaactgtaactgccaagaagtgagggaggaaccactgcagctcttcaggaggggcaaggacgtggccaccaagtattatatgcagaataggccgcctttaagagcaatagcaaagtcagatcgtttcagaaaatataaaaaaaagtgggaagtgaggtggaaggctggggccggatcatgtgaggagtgttaaagcgttggggatacagtcgagagctttactgggttccagcagggagtgatttgtgcagagcaggcactacagctggggtagcaggtcaggtctgcttcttattttctgaggattcacaagctaagaatggttcttaatattttctttctttctttttttttttttttgaggcggagtctcgctctgttgccaggttggagtgcagtggcgcgatctcagctcactgcaaccttcacctcctgagttcaagcgattctcctgcctcggcctcctgagtagttgagactacacgtgcacgccactgtgcccagctaacttttgtatttctagtagagacggggtttcaccgtgttggccaggatggtcttgatctcttgaccttgtgatctgcctgcctcggcctcccaaagtgctggggttacaggcatgagccacggcgcccagctagttcttacatttttaagtggtcggaaacaggatcatttgtgaccagtgaaaattttatgaaaatcaaatttcaatctccataaataaagcgttattggaacatagccccacctgtttctgcaacacagccactacactggggctgctttcactaagcagtggcagaattgagtaactgtgatggagacgagatgtctcatagaactcaaaatgtgaactgcctgccccttcacagaagtgtgcggatgcttgtagagaatgggttgtgtaggaagtggtgacattagggacatgaggtgggagtctctcctaactagagtggaggcagtggaggtgggtgaagtggatggatggagttcagctatggaagtagaatgggcaggaagtactggcaggttgtctccctgtttgtgttcctatgtaggaatacctgaggctcagtcatctataatggaaagatgtttctttggtttagggttctgcaggctgtacaagaagcagggcgccagcatctgcactgctgagggccttgtgaacgggagccagctgtgtagagatcacatgcactagaggaagtgagagaggggagggaggtgccaggcttgtaaacgacctctctcataggagagttcactcctgtgacagccccaagcctttcttcagggatccgtccccatgacccaaacactaggccccacgagaagcactggggatcacatttcttcatgaggtttggagggtcagatatggaaaccatggcatgtgagcagtagggaaggcgactcttaggcttttgcctaagtatctgtgagtgcctgttttttaggaacatttactgagagcttactgtgcaccaggcacagtgcttgctaagtacctaagtacagtatctggttagtccacatgacacgtatgctacatgtctacatgtctacacgactacttagtctacatgacacgtacggtgcccattttactgatgaggaaactgaggcttgagaggtttaatcattggcccaaagttacacagcttgtatgtgactgagccaggattcaaaagcctgtcctttgaatgtgagctttcactctgcctgtgtaaggctatccgttacagtcaggagacaccttagaatgacgttagaaatgatagtttctaatgtactgaattggaactgggttttttgtacagtggcgtatgctttacatatgtgacgaaatctgaacctcacaggagtcttagatccactttactgatgaggaaacaggcacaaaaacagatcactttcttactgcctgtaggtagtgagtggtcaagctggacttctatcccagctctggttcttttttagctaccacactaagatgggcccagtgtgcgtgcgttccgtaatggttctgcagggctggatctcaaggcccaggctcttggccttggggtgccattggctcatgaaggaacggggctggtagcacagtcagcctctatcttttaaagacttggccaccccacacaggtgtactggaaagcttctattatgcctcttacttgtgcctttcccacgtgatcttatttaagcctcgccacagttgctggtgtgtgtgctgcagttaagcctgttgtccagggaacagaggcctagagggttagctcccaaggctgcacagcaggtgcctaggggagctggtttggggccctggcagcctgacttaaaagctggtgctctccaggatataacaggcgagtaattgatacttcttaaaatgaggaggaaatggtgcttggttatctcagatgaatctgacagaatatgcgctctttcatccataattaaatgtggatgttgaaaggagatgtgccttcttccgaaagatagctggcctgatctcttccgacgtaacgctgtcatgttaaaagaggaccttgtggatgaaaggctactcgggagacctggccgccccctgcagcgcgtgctgagtgattggatcccagctgctttcatggccgttcttcttggatgcttgggatagtttgtagaccgcctattagctaataatggaccaatgttgcctttcttaggtgtggtaatttcactgccgttaaaagaatgtccttatttccaggagattcatgatgaaattttgggggtgaaattggttgctggagcttatttgtatgtagatcacccagaagtatttttttttaagaccaagtcttattctcttgtccaggctggggtgcagcggtatgatctcagctcactgcaacctctgcctcctggttcaagctattttcctgcctcagcctcctgagtagctgggactacaggtgtgagccaccacgcctggctaatttttgtatttttaatagagacggggtttcaccatgttggccaggttggtctcgaactcctgacctcaggtgatccacctgcctcggcctcccaaagttctgggattacaggcgtgagccaccgcgctcggccagtattttttatgtatagaaaaaagtgctgaggctccaagtgaagggtagagaggtgtgcattttgcaattcaacttttctatacatttggaatttttttaaatgaaagataagaaaatgttcactgatgaatgtataaactaaatatagtatatccatacaatggcatatttttcagccattaaaaaagaaatgaagtactgatgagccttgaaaacattcggctgcatgaaggaagccagacacataaggccccagttgtgtgattccattgatgtggaatgcccggaagaggcgagtccacagagactggaagtagattaagggttgccacgggccaggagaggggcgtgggactgacttaaagggaacaggagttcctgttggtgtgatgagaatgtggacttggatggcagtgatggctgtacatctctgaatatactagacactactgaattgtacacttttgaagggtgaattttatggtatgtgaatcatagtgaaaaaacatttgaagggaaaagtacccttatgccagggtgcttgcccgtgaccaggtggcaggtccccctccaggtgcggctgcttcatggcaggaggcctggctggggaccctgaggtgtgcaggcctgaagtacactctgttgtgccccaggcgagggttaatttgtcctggtttggtccttttcatttagaggaaacctgtttgtatttttaaggtgctttttatggttctttgtcacttacctcttcatctcccaggtagagcctctgggaaacattctgataggagagacaatggggtgaggctgcatagctttgagaaggaggcctagttggcttctgaaagaggatgtgtgagctgtgagtccaagggagacgtatgttcgtgtaaatcatgtcaggccgtatcttcccccagtgtttcacctttttcaaaggtcacaatcgttcttggtggatggattatttgaaatagtgacctgaaagacgaaaatcttatgttacagatgaaaagagcaaatgatgcattttttttttttctagaggaaaaactgacaccccattttaaggaattcttctgtcagccaactgtttggtatgctgtacacaattctattcttttagcttttcttctccaaattgattttggtggtatcttttggccagtcatgtgaaaaccttgtttacccttggtagggcacgtagctgcagctcacacggtgatgtcatgcaaacgatgggcaggaggttgtggcctgctcgccaggggctgggaagcatgtgatgtcccttcacagcagccaggttcccttggtacagaaatgcctgctgtgtggttatttagggcttagtaattttggcttataaagtaattttgatggattactcttggagttggaataaattgaccaccacaattacacaggaaatgaggatgaatggcattttaaggttaggattttcccagagtaatcaaatgctgatattttcatgcttcatctgaagaggacataagtctgagactgtgggaagatatgtgcagtgtcactgtgggtaacgggaaggcccgagtgagaccgtgggaaggtgtgtgcagtgtcactgtgggtaatgggaaggtccgagtacatttcagttaggaaatcatttgtgcctctattaagtttatatactatgtttactggcctcttttatgcttgtcaaaaaattactttttgtttgttattttttcgcacttctagttttgttttctcagtaaccatttctctgctcacatttttcatttttcttcctggtccatgtctagtatagcatgagaattggtgtccactgttgagcaatatttaaatgcattgtgtcctagtgaagaagtgtcttagatgtctgtgaagttctcacctcaaactctttattcagtagagatgtctgcatttggtctaggacctctgttcagtattgtaatagataagagaaaagtttaaactcttgagaataagtgattttcttttaaatttagatttttcgtttgaagtggtgttactatatataattaattacctgccaccatagtggccatgcttaatcatttggacttcaaacaaatctctttttgaggagcacacaattttttttcttttgctctatttcctttagagaggaacacacaattttaactataaattttactcctctgatttaatctttaaaaaatagagtttaaaataccatatcaaatatatgactgctaaaaagatgcatgtgcttattacataccatatctttttttttcttttgagacagggcctctgtcgcttaggcaggagtgcagtggtgccatcacagctcactgccacctcctccccagttcaagggatcctcccacctcagtctcgcaggtagctgggactgtaggcgcacaccaccgcacctggctgatgtttgtaattttttgtagagatgggggtctgtctgtgttcccaggctgctctcaaactcctagacccaagcggtctgcctgccctggcttcccaaagtgctgggattccagacctgagccaccatgcccaaccgtaattggttgttttggccccattgagaatgtgttattcagtagagcagattgttctatggatccagaaactagatctattattagaataagaattttctaactctttcataacctgtgacttaagaatgagacagtagaagtttttaagacagcaagagagtctttttatgagatccagtatcagcctctcataagtttgttaaaaataaatttatgaaatgaaactcactagaaatgtctctgtctagtacagggttcatttgcacagtatcttatttagacgtaaaaatccaggtgggcagagaaggcttctggtgtgtctgcccccaaatgacctgttcccaccgcttgggctccattgaagtagcctcgtgaactccataagcctagatgttgcgttattacctcagtgcttttgtttgagtccaggaagtcagtgatttttgagccttttggaaatcccacccttatcagaatttctccgattccattgatagcctgtctaatctaaaaatagcatgtggttttatctttagtctataatttcctctttgcttcaagtttactgagatctctgattctcaggagaccagatacaattggtgtgggtggtgacttggcctcactgaacaaatgtctctctttggggcctaagcatatttgtggggtgcctcatggtacttgcatgtagctcagtaaggcatggagctttataacattggttctaaaacttacctgtgagtagaagtcacctgggaagttgcttgaaatgcagattcctgggcctgggccccagagaccgtgattcagtaggtctggagcgtgggtcctgtgactgtgtttgttttttgtttgtttgtttgtttgagatggagtttcactcttgtcacccaggtacagtggcacagtctcggttcactgcaacctccatgtcctggattcaagcgattctcctgcctcagcctcccaagtagctgggattacaggtgcccaccaccatgcctggctaatttttgtatttttagtagagacagtgtttcaccatgttggccaggctggtctcgaactccatacctcaagtgatccacacgcctcagcctcccaaagtgctgggattataggcgtgagccaccatgcccagcggactctgtttttaaagagcattccaggtaattccaaggcaagtggttcaggtacttagaaaattctacagcagaatatacttggaaaaactcaagtttttccacatacttggaaaaactctctagcatttgttggaatttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatcgttttcatccttgaagactgtcatatattttcaagtgtctttcctccctgttattttaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatgggtaagcacttagttctcatcttgggctgtttgaaaggactttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacctaaaggtcagcatgggctccatcatacagcggtcaggtccatcatacggcggtcaggtccatcatacagcggtcaggtccatcatacagcggtcaggtccatcatacggcggtcaggtccatcatacggcggtcaggtccatcatacggcggtcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaactatgactcatgtttggtgatgttggatgccagttaataaagtccagaacttaagcccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggctgcagtgagccatggttgcaccactacactgtagcctgggtgacaaagtgagaccctgtctcaaaaaaaaaaaaaaaaaatatagccccatcttagctgacactagtcttttgccagggccttatttgatcagacaaaagcagtgtttcggatcctagaagtctttttcaggaacaacccttaaagttttagtatccgtgtgggtggtagcccatagacatttctgcaagagaacagcattgttctgtggacatatttgggttttaaagcacaaatggcagtgtggagagggtttggagttacttttacttaggaagccgatttcctcttaggatagtctttgaaagtcttcttgggcaaaaataagggaaaaaaagcaggggctagcttgcagaaaagttgatggtctgaggaattctcagattctgctgtttgtatgaactggctctgtaaccttgggcaggttactgatcttgcgaagcccagctttcctttttttacagcggagatggattcatctcatgggctcacggtggggcctgagcacagtgatgtgtgcaaggccctcagcaggatgccaggtacatgataagggccctgtcagtggtgaccactgtgacgagggtgccttaaaaaaggtgggcctccaggctgggcgcggtggctcaagcccgtaatcccagcactttgggaggccgaggcgggcggatcacgaggtcaggagatcgagaccatcctggcgaatacgtgaaaccccgtctactaaaaatacaaaaaattagccgggcgtggtggcgggtgcctgtagtgccagttacatggggggctgaggcaggagaatggcgtgaacccgggaggcggagcttgcagtgagccgcgatcacaccactgcactccagcctggaaggtagcgagactccgtctcaaaaacgaaaaaataaaataaaaaaaaaaagttgggcctccaaagcctgaggaagcatgacatacccaacatttttacagttgtgacacttaatttcatctggcccaatctcagtttcaatccaggttgatctgtgttttgaagataatatagtgcttgatattaaatgagaaatgaaggcgtatttgttcaactcatcagaccagagtagaaatggttctacagctttttgagatacatacttctttgggaatccgtgagaaccagtggactcttttcctggagaatacacacacctacatgcggccttcacagagactcaggcacaggcgtcctgaaactggagctcgtcaacttgtgtgggaggagcagagggctcttgtgggtgttcgggtgtcacttgtgaccgtggcttcgtgttggacccttgtatgttgcaaaatagtgcacctaacaatatgtgtaacccagtaaagcttcagatgcatgttgatttcacagcttttaaatattttaattacgtaaagcgaaagtaatataaccagtaacctgtgtgaatgattctttgtgtgaaaatgggtttatttgttatttaaatgtttttagtgaaaggtatttaatatgatgtggtaaaccactgatagtatctgcattaggtacaaaaggactttaatttcctttttgaaaaaaagtagtacttgaagaagttaatgttttcgagtgaaagtatttataatgtctttggaatttattttcacttttgggtgtttttgtttttgattattttcccccactagactaagtccgtaaggacaggagccctcccctttagcccccaggtagagcaatgcagggcctacagcaggtactcgatcagtatttgttgaatcgaacttagttttcttgtccaaaatttggctaaaatattcagttatagttttcagcgcttctatttttccccactctgaatgtccagacttaaaatgttgactttataagataaagaatttaaaatactggcaccatagtaaaatgggacatgagttaataaactagaaggctgacaggtgccatttctgttggcttcccacagttaaacacaatcttattgggaattaactctctcctggtacttctggctttagagaatagtgtgcactttgttttcccattttacccctgagatccttggagcccgttccccattagagtgttttggagctgggagagagtgcggagctgtctagtggggcctgttcattttctaaataatgaagcaggcccagagcaaggaagtgaaactcgttagtacaagagctggggatgccaggtccatgttcctgctgtgaccggcagatgtgagggcagtggcagggagtggagggacagtggtgtcctgcaggggtcagggcctcaggctgtaaagccaagactgcctgggtccaagtcctggccatacctcaggcacccttcacactctctgtgccccggcatcttcctctgtgcaatagggccctgaagagttttaacaccacatggttaatgagggagcacatgggacgcggtgcactgggcactccctgtttcctactgtcaggggacagagccagggacatcctcctctcatcaccaccagcaccgccctcccccaacagctcttccttaatccaagagctgacagctttcctccgagaatagaagcctgcctcagtcctgccagtgactcagtttaaaccagcagggttttattaacagcattggtattggctgtcaggtcttgatgtttgataaattagctgattaaaaattcacacaatccagtgcattttttcatatgctatccagtggcatagctagtgtccctcccagtgtcacgtagagctgcagactctccccacacggagattgccgagctggcagctgcgctggggctctcagctcagccgtggttcacactgtcatcacagatcttccagccatgccaaaattacagtagcccagttgcactttgactagaaagtccctttgtcagctgtttcagtacattctgtgacatttagaaataatttaggtagctgtgttgggtgtgtacaattagtaagtgatggaatgagttgaagcagattcaatacagtgagctggtttcttacctccaaacttaatttgtgaccaaataattgattgctgggaggggaagaaaactaattccttcattttatttcccaaagtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaagtgagtggtgacaaacaggtttaatttcctttatcttcctatgaagtcttaccctagcacttgttttggccatttctaaagtaggtaggactaggtgattttttttcccatgagtctacagaatcttggaatttttggttttagttatggagtcattttggctgctttaactatgtctaaagcctctctgaaaaagaagctgagaacaggtacgcttctggtttttcaggcccctgttgttaatgtaatttctcctttggataactggccattctttttcaaaattgatctccagaggactttacgatgaccaaatcattgacctgtctgttttcaaacttgagccattgtctatttctgggagtcactgtgtgtcgcatctgagtctagcttaggggaggggcaggatgcttagagtgtttgagagcacagttggtccacatataatgatactgttttttatacctagatgcagacaacatatgttttacagagtcttcatttgaggattccagaaatttcaaatattacaaccactcctcacacggtaagaacaattgtaatgatctgaacattgttattttggacttatgtaataaatggattccttctaccaactgtaaatcttttataaatgttaacagcaccgacacaaaagcattgttattgaaatagagtttttacttattttagagaatattttttcattggttgtatcatttgctagattaggttgactaacatcaattcaacattacttagtatttttcacctgattattttcccctcaaaacacagaaaagcaaatgcagattcatttggaaagaaatcttttcccagttccgttgtctctaaactgaagaggttgtaccttgtggagaggaactgttctttacgtgcatttctcccattgagacgttggttctctagacaggtgatggcctgtattgcggggagtaaacgcctcctcctgtgtttcaccccagctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggtaagaggcattctgctccgttcctcctcaggcccgactgcagcagttgtggattcagaatatagcgctcacacgcagtcgtgccccaggttgttcaggaagtgcatgtctgtaaaagaggatgtgtatcagttattttacagcactaatcctttattttaaagtttaagattattttcctaaggatacgtcatttttctgctggtactaaaaccattgggttgctctgaaaagtgacatttggactgagttaaagggaggtttttctctacctactgatttagaattaggctattgaatgctgaatagatgaatttttgtaaattaaaggtactgtatcatcctcaaggatgagaattccaccttcagattactaaccttaggtttattaacaagtgtcagggtgcctgcgagtcctttgaattttttatgtaaaattctgtgtgcatttttctggtgacaaaaatgtttctagattgttacaggctcctgggcagcatctcctcccgctacagataaacctgataagaacgaatgcctaagtctctaaactctgatgaggagagttatccttttgaggatttccattctgttttcataatttttatgtgctgaaatgagttgtttatcttttgctgataaagctgggtattgctgactttctgaattattttggagttctcccttcattaatatttgaaaattattgactgatgaaacagcttagttacataataagaaaagttgatattcttgaaccaactatgtattatctgctgtcatgaggaattcagtgttaagcattgctgaaatggaatttaatattctcaaacaatgctgccttcatagcagctttcatctacttttgccagacttaatgtattgatatagtacttaatagatttaaagaaattagtccctgggcttaagaaatctctgttctagagactgggacattttagaagactattgcattttcttttgttcaaatagataattaaagtgaggtcgtgtctgaatgaagtttttgctgtgccttctttataattcagcttctcttccagagctgtggcacatggggaaataagcatgggcagagaagaactgaatcaccgcagggctctagctgcaggctgcggttcagcagagtgcgcctgcagaagggctgtctgcaggaagtctttgcactggaggctgtgtctgcctgcctgtcctacctccccaaagcgcaggctcagctttggcctcagacctctctctccccccggggctggagtgccttctctgtgccccgtcaccacactggttgatgccaaggaagggagtcctcgttccctccctgtgggaaaggagacgtccttggtttccggaggcttttccagtagatacttggtttgggctcctttcctaacatcctctctttcagtttcataaatggctgaatcacttctgtgggctgccttgagagccatgcagtccattctggtggtttcgatatgtgtttgtgcaggatacaagtgccagaccagtcactgttgagatttccccattgcactccgtcagttctgtctttaaaaagcgctagcaggccgggcacggtggctcacacctgtcatcccagtactttgggaggccaaggcaggtggatcacaaggtcaggagtttgagaccagcctggccaatgtggtgaaaccctgtctttactaaaaatacaaaaattagctggccatggtggcgggcgcctgtagtcccagctactcgggaggttgaggcaggagagtcgcttgaaccgggaggtggaggttgcagtgagccgagatcgcgccactgcactccagcctggtgacagagcaagataccgtctcaaaaaaaaaaaaaaaaaaaagcgctagcaaaatccacagcacatcaagtccagtacgtactgactggagtcaggcagcctctgcacagtgcttgccttcttactgagtgttggcgcctatggggaggcatgcgctctgacctagtgtgacagcagcagctccagagcctctgaattggtgacatggaagtggaaagttcacagcatgtgtgcgtcctgaaacaggcgttctttcctaagtgacccagtgttgggaagaagctttacccgccagtagttgggaagagttacatatatcttataacttgacatgagtacaatctattaaatttaataaaacacctgcccatgtttgatgaggtttcattcctagctctagtgagtattatttagagacattaatggtctttgagtagagatttgaaaccatcatagcaaaccaaaattttaatgggaaagaaacttgattttgcttatagcttaccacctacacccataataaatctacacccataataaatgatttttttttctgttaatcttttcttagctgaagggttgaaaaatggtatattattgttttaacacgttattagtgacgtttaagattctttcccaaaatttatcaaacttgtcatcttaggtgggtcatggtttacctggatccccatagaatgtaactgtacatggttatattctgtgtacagtttgtgttgtacccatttttgtaataggtttttcttttttttttttttttttttttgagacagagtcctctgtcgcccaggctggagtgcagtggtgcaatactcagctcactgcaagctctgcctaccgggttcacgcnnnnnnnnnnnnnnnnnnnncgccattctcctgcctcagcctctccgagtagctgggactacaggtgcccgccaccatgcccggctaattttttgtatttttagtagagacagggtttcatcgtggtctcgatctcctgacctcgtgatctgcccacctcagcctcccaaagtgctgggattataagcatgagccaccacacccggccaggtttttctttttttgtgttgttacataatagatcatgattatttaaggatttcaaatttttatctcttagcttatggattttttcccatttaaaagattttcccttgggagaccaaggcgagtagatcacctgaggttgggagtttgagaccagcctggccaacatggtgaaaccccatctctactaaaaatactaaaattagccatgcgtggtggcgcatgcctttaatcccagctactcggaggctgagatatgagaatcgcttgaactcaggaggtggaggttgcagtgagctgagatcatgccattgcactccagcctgggcaacagagtgagactctgtctcaaaaagaaaaaaaatttcctataattttatttatggaatcttggaaagttttatacatttctttaggttctctaccttttatgttaggtttattggtaactactttatgtattttcagttcctcatatatgggattttataaaattctgtgagtttcagtgaactattttcaaatggtcattctttgtcttcaaataatatagtttctttttctgtctttgtaataattatatctctttttctctttttctttgattcaacgttagtctcatccttgattttaatgggactgccactagtagctcacagttaagttgaaagtttatcattgcttgttaaagtaggtatttgtgatgacattaaacatctagccagcatgaatgttggatttttttggggggggtatccaaggataattgcatctccccccggctgcctttggcttctcatgtattttatttatattattgtattagcttcctgacatttaactattcctgcgttttagaagacaaaccctgtctgttaaaagaggctgatgttggtcctctgacctgactttgcagctgtgtcattgagcacgtgtgcgtctgtgtctagaatcggccttcgtctgcggttgtttttggcggtttcagtgaggtgatacagcttcttaaaaagagttggtgtactctctttttctctgtaggcaggagaatattttaaggggacaataattatctttctgttctcaaggagttccaagcatttgcctagcttgaagtcatctggagtccattacctctctgagaagaaatttgataactttttcattttcaagacagggtctccctcccatcacccaggctggagtgcagtggtgtgatctcagctcactgcaacgtccgcctccctggttcaagcgattctcctgcctcagcctccacagtagctgggattacaggcgcctgccaccatgcccggctaatttttgtatttttagtagagacggggtttcaccatattggccaagttggtctcgaactcctgaccttgtgatctgcccaccttggcctcccaaagtgctgggattacaggcgtgagccactgggcctggctttcattcacttttacttattctattctatttaataatgaaaagataatttaatgctatgaatttgcttgttattactactttggtcagttcttgtgtgctttgatttgttttaatgttctctttcttgttttctgtgaatattgaaactggttttggttttctttttgatctaagactaatttcagagaatttttaagttttacaatattgatgtttttgtttatacttttgttaatgatggcaaattttgttgagtcaggagagattatggcttttataattcttgcattggggatttcaaggcttccgttatggccaaatatcactctctcaaaatgttgtaggtgaatagcatgattcatgtattgtaatactaccaacggtattaattaggtcttttacagcaggagtcttaaactccagtactggcagtgggcctgaggccatggggatgagtgcatggtccaagaataacacagtgggtctgtggtgaatgggaaggcacagacaggtcctgcccgaacactttctaaaacaccatgtgggcttaaaacataagcctgtcagaagggagccccacgaggacccggatctttgtgtctgtccgattcgtcgtgtcgtcccggacatgttgtaggcctcaagaattatttgttgtcatgaagtcggtctggggcctcgctttctatttgtgtctgtagtttgtaaactttatgccaaataaagctgtattttttttttcgtctacctgttctgacaaggacaaaaagaagtgtattcctgtgagattctagcagccagatggtattttaattcacagtaaagttcatgatttgtgttgtgtctggatactatgtgtcatccatagtgaaacagccgttgggttggaaggtagcgcatgtggcatcgttgagagccgggtgtgaagcctggcctcagctctgccagttgtctccaagtctcattttcctcatcttcaaatgagcttgggttatttctccccccggcttactgtgaataataaatgaggtgctgtctgtgaatccatcaacaaaagcggctcatcacacaaggaacaattcatacatggcacctattggttattttggtttttgattctttttctctcttcttggtatttttgttgacacctcttccctttatgattgtttgtctgatacatcctggcctgtcctctcctttatttacaatctttgggttatattatgctttagttctgtgtattaaccgtaatactcagttttgtttattttttgaactgatacaagtggatgacttttatctgaaggatttggctcatcctgactgctgtgttgattatccagcgtcgcatcccatgcttgtttttactgggtgcccgcttgccatgtcactgtcactcagcctgaaccctgctgcttttcggcctgtcccagcctctccagggctctcagttgttcacaggcagggtcattttccccattggctttgcctctccgcctcgctcgtgactgggggcacccgtcccgatcctggtttccgcagtgttggctgtgtgtgcgcctttgccgctgctcatctctctgccaacagcctcaccaataatcaggcctatttattttctcattttctcttctcctaattcttgatctcatcatttgtgtctctcttaagccaacgtccccttaatttctttgttacctttttcatccttagtcttcagagtctgtgttttcttgaataataagacaagttctctggtagaactatgccagtagcaatagtagtatctttcccattcaggttataaaatctacttattgtcctccgcatgagtaaccttcccttgtcccgccccctgcagacactttggtgtcatccttaggctctcctcctctcctgtgaaggagaaaagtggtattcagctttcgtgtttatttccaaaatagacctgaatttctgcttgagttgcataggttctgttcccattcaaggagtggggaccagtgtagtcagctatggtcccaggggagcaggtgggagctgaggaccttgggtgtctaggggaagccattgtcacacagttcattcttcgtgtttgaaggcgctgatgccagggctaggggtgcagtgctatggttgctgtcagctgccctgtcgggaggaaggctgtcatttggggacagtccctattgtcactaccagccttgcctgattaagatgccctcagatgccctttccagaacaactaagggctctaaatagtttgctgtccttgcctgggtctgcgtttatgtttctcccgtggagggcggagtggaaggattgggtttcccttgacactcttccagggtggggctgcaggttttctgatggaagtaagctgtgggttggctcgaaggtctctctctactttgatcctggagaatgttttcactttgcttggcatttcagttgagatttgaggtggaaattccagagtttgtgttctcatcgccctatgaatcatatcctggtcctttctcatgctcaggttttagaaggaacatttttaatattttcattccattgccctctgaccagacctttcttcatactcatgttttaaaataaacatattttacatacgctttaaatattagggcctgtgacctaatttgcaataagaattctttataaaataaaacttggtggtatctttaacctaaggacttggacctgcgaatagatgcttttacactttatttccagtggctgatttttgtttatagagtaggagctgctgcccttgcttgtttttctcatgtctttctgttacacttgataggtgaccagtaacttagcctgcacctgcagtgagatctcaatgctgctgagagcacaggttgatttgtgaagtcagcttactttgttgcaaagattaagcctaccctatgcagggaaaccaacatcatcatcatcattattatcatcatttgttgttataataataaatcagtagatcaccttcgatccatcactatgattggaagaacatctcagtattacctgctgttgggtaaaatagcactactgttaattctacagtaggactttttaactttctcctactcccctttgtaagagacaaacgaggtatgggtgagcaatccagatatttgaggattaaatgaaacatgttgaacatctgattttatataagatgctgtaaaaagccgaagtgaaataggtgtgctatgccatgacctccactcagcctgcttaggaggctgaaggctgggggcctattagtcctgggggaagctgtgattagacgtggtcctttcacgcatcagaatcacgtttgctacgaagtctcgtagccaacatcagatttttagattaactgtaaatgttaataaatgaatattacactaacctacttttgaattctaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggtgaggacctttagtgccggaggtgtctgagtccaggcacaagcgtgagcgctcgggcattctgactgtgctgttggaatatgttgagacaaggatagcacagcacttctgtagtttttggcagtgtgtggtttagaatatgaatcgctaggtaaacacaccagtgctgaggttctccattctttgtgtaaaaacagtatcgcaaaatattttcatgaaagtttgttaactaccttgtaagtgccacaggacagagaagaagaaagcaatcgtggttggatagttcccagcggagccctcggccatgctgccgtggtggctgggctgagctcacagctctcagtgcgcttcgtttagatgtacgtaaagaagcagatctaatttttagaaacgtgttctcacaggcctcccttttcctattagtgagatcctgcagtggttgaacaagtgtattctgggcagatctgtccggctgctgagagtgagagagaagagaaaatgagtgatatgcagaggtggatggatgtgtgggtagtagtcagtggtggttttcactgtagaaaactcatccagaattggctaatgaatttgtaaagggaataaatcacaacggaatggacttctatttagaatacactacaaatctccgtgtctagttataaaaatctaaatttatagatgggcctgccaaaatagttttgaagtctattgcccttgtcacggtggctcatacctgtaaccccagcactttaggaatccgaggcgggtggatcacctgaggtcaggagttcgagaccagcctggccaacatggtgaatccctgtctctactaaaaatacaaaaaattagccaggcatggtggcacgcacctgtaatcccagctactcgggaggctgaggcaggagaatcgcttgaaccagggaggcggaagttgcggtgagccaagatcctgccattgcactccagcctgggcaacaagagcaaaactccgtctcaacaaaaaaaagataaagtatattgcctctgaaatagaatccttatgtagatttcccagtttagtgtgtgtactttgttttcaaactcccattccttgacaatataggaaaattttttctctaatctctttaaggaacacaaaagtctaagagccaacaaatcacattacctttaagcttgagagcaaggagtttaactttctgctcattgaatttattaggaattatcctaatggctaggagaatgaacagttggcccatagccattgattcttggtcgctagtaagcatcgtcctcctaatagaaaagaggttgtgcctgtctgcaggactcagtccctaggagaccccacgcttcctctgctatattaggtgaaagctttgatcccatgtgttaaagtgcccctttcacaaaaacgaccctcccttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtcccttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgatcaatcataatgggtttttacaattaataccagtaggtggcatcttgagtgttgaacagaaccactcataaaagctgagttttgctttctccaggtttacgatgcctttaaatggacccagcaagcgaaggtttcttctttcttttcctttgtaaaaatattttatctacagaaacaaccttgttactttttcttgtataatcatgtggcatttgctctggtccggtagtacttagccacttttaggttacaaatccccttgagaatctggtgaacgtttagggacttttctgcagaaattgcagaattcccagagcccttccatgagtataggcctgtggagtcctaatgtaaagcccagaactccaagccaccaatgtcccatggacacttgtcactgatgttttctggctgtgggtgccacctccatggccagctcagggctgcttgctctgaggaggacatgtggatttggggctggtgtttcattcccaccttctcctgaagatgaacagcccgaggaataagatcctcttgtggtacatgggacagacttccttcaaagaaagaccaaagtccatagttctgaagacgaagattctggttcttggtttttgttttatctttaaatgtgtcataaaggattggctggtcattctcgttgctttctagtcatttaatcctcattcttaatttaatttcacatctcagagttgacctttcattcatcatttctgtctgacaggttgtttgtggacttcccctgcattggtgctctcagggcgtgtgtgctggggatgggccaggatctgtctgttgttttcaagaatgggaaatgtttcatgaaggaggcgtgtttgccagcagcccccaggctgtgccccctggctgcatggcagcctccttggttcacaccagtaaggagagttggagctcatctgtcgagcagcccttggcgtcctgggtagagaaataaaggctgtgacatgggaaatccacaggaagcccgctcctcagagagagttctccctgaatttgtgtggccttggaaggagcagcagctctcaggccaggttccgggggtgtctgtgccacccttatccctggccctacctcaccatctcgtgaccgacacaggaaatagctttctgtaaagtcacagcactgtgaagggagagtccccagagttttgttacattgtgtttttcttaccgacctcccagcaggctccttttattagtgttatttaagctggggagaacgtgcataccatagtaaaggtctctaatcttaagcacagcttgctgtgtttgcagtctggatctcagtggaggaacttttggaagccctccttgcctctctccttagtttactgccccccctcagaaggtaaacctgttctattccagcgttggtccccacaggttaccctcgcctgtcctgtgctgggctgtggctgtctcctttcacttagcacttctgtctgtgagcatctcccctgtacttctgagtactgctccttcgtacgagccatcacgaggcatttatccatgctgttgtcggtgggtgcccagatgttggcagtgtggggctgttgtgaatacctgccctgcctgtgagcctggggggcgggtgcgctcattccttggggacccaagagtctgtcttgtcaaatgtcaaaaccctagtgtttgccatcttcctgtgtaattatccttctgtctgtgaagaggcccaggaatgcacggcaggttttctcccaggcgacttaggcgtttccgaataccctgtgtaatgccaccctgagacagaccctgacgaggcgtggtgtgtctgcctgcgggcttggaccgcacctccactcccgcagggccgcgcagccttcagttcatgtggcctcagccttcagttcacgtggcctgccagctttagctcgggaagttttcagtgactggtacatttggggagactcgtatttcaaaataggcacataaaatgatgtcgtttatattttgatgacaacctcgtctcagtagcgtcaaatgccagtgttgggacagcagtgacagctagtgccaggctccaggaagctggggtttgcatttccactgagtgcccaggacagagcctggtaggtcgtaagggttgaacgaatagtgtaaaacatctgttgaaaaaataaagctttagtctggtagaattcagggtattagcagctgtctttctaaatcagtagacacaggaaatgatcttctttaattggtgtgaatgagcactctttaaaaatgtgtgagatctcaccatacagatgtgtgggttttttttttttttttttttttttttttgagatggagtttcacgtttgttgcccgggctggagtgcagtggtaccatcttggctcactgcagcctttcacctcccgggttcaagtgacaattctctggcctcagcctcccaagcagctgagattacaggcgccagccaccacgcctggctaattatttgtatttttagtagagacggggtttcatcgtgttggccaggctgattctgaattcctgacctcagttgatcacccaccttggcctcccaaagtgctgggattacagtcataagccactgcgcctggcccagacgtgtattatattgtgtttatttgataaatgcactgttgaacatgcagtatatgttcagatagaaaaaggaagtgccagaataacccagctttaaaaaggtcttcagaagaaaggaagtctcactttttaaaataaacaaatgagaaagtgtttttgaagaggagcagaaaatggagcaacttgattccagagcactcgctcccctcgtgatgttgccggccacacgcacctgcgacctcgtgcagaaacgtgcagcagtgctttccagctggtggcaggtgatgtacatggtacggagacagagggacgccatggtggcaggagcagccgtggtggagagcacagggcgacactcggcttggcctggatgaccagtcatgacgagctaaaagtcctgccgttttctgctcacacgtcgttcccacgtctgcacattgagtggtgatgttagccggtgctggctgaactctgttctctggcggagagactgccagtttgcagagtggacagttccagacctctgtgaaagggggatcatgaccgtggcacgtgttgctagcaccctcaccgcgtccagactccctcttgagtgcctttctgaaatgctgctcctcggcgctttccccattttacagatgaggaaactgagcacagaggtctcagaggccggattcaagccttatagcttgagctgcatggcccatgatcttatcctctgtgctgtccagcctgcttgggatgcagacgttgcgtgtaaagtgcctccatagtgcccgggactcggttgggtattcagtgtatgctaactctttgtattaaagtatgcagaggtatctgcttgtgtcagtttgaggatgctaaaacctgaacatgtttaagacacattcagaaaccagctcatctcttcctttgatacattgcccagctgtcggccctggtgtgttgggtgtgtcagtgacccatgcagtgaatccagaattcacgatgttcaggctgtgtcatagtgcaatctgtgatgctaaaaagtgcacaggttccatagccaagttacaaagacgctcacctcaggattcgataaagagatagtcaggcgctcttttgttatcttcgcatctgccttcctcaacaatgcagttccaggccaatcataactataaatggaggaagttcccctgaagtagttgaggagaggaacactgcctcagaaaaggcaggaaggaaataacaccagaccggctaacacttgtttctggtggcaagaacacaggaaggtaattttttactttgcccagctgttctggtgtggggggattagcagtcacaggaggctgggttggcaggtttccccttgctcctgatttgcagccttgtcgtgcggccttaggcacactctccgtcgacactgtccccttcaccaccgcatgtgtgtctgcaggccacgcagggattttcctgagtactggggagctaccttttctagtttcctcagggaacctcctccttttaccttacagaagagagggatgggctgctaggggcaggtggggggctgcagacagcccacctccagagcccccggtggcgatgtatctgacttcagggagcttcttcagtggttttgaaagcaagatgcttgtgcattttggactacagagacaacatttgttactttttttatgactccagttaaaccttagtgggaaccagattaaatagtaaagtcttgaaaaaatacctgtagcagcgcagcttacctgccgctttccttttgttttctccaggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccatgagccggttctttgcgtggtttgtcctcagtcgctgctggtgtggcgtgtggattcctcccctgtcgtgtagaaggcgcagagcttcccgagtcgggaactgaggggagggtggggaagtgcgctcctgcacagccctcggatgctccggcgcgtctcctgattctgcagcctcctctgcatggaagggtagtttcagcatttggagaagacaaaaaacaaaccaaaaaaccctcacgttgttgttcgttgtgtaatagaaagtatagaaaaactatagaaaaatacaagacatttcaaccagtggaagtaggatagagtgaatacagatgacactcatggtatcactggatctcagaggggccggagttgtgagcccaggttaaaaaaaacggggcaggtttcgaaaagccttgtgctacgaaggataccactttccggagacagaactcatgtcttcaggatatatcacatgtaaaaataacccatggtgtcaaacagattttcttcataaggcctttgcacaaaaggggaaaggcaggtggcgtcgggagagctctcggatccttcctccggtgcgttgtgcccttgatgccccgggctgtgtgaacggtgagtgagtaaccacatccatccgctccgtctgtcccgccagcccctgctcctagctaggtgcaccctcgatgttacgagggaaattctctccagaaagtcagttggagggttgacagagtcatcagggtaccagcctgtgatattgtgatgagataagaaacagatgtggtctgggccctaaatccctgggacagaactcctgcaacccctgtagatagggcacgaggagaagcccacattttcatatttgctctttgaccccttgaccccagctcctggcctagagctgctaaggcctttgtaatttcctgggtgatgggagcatcttttgttctaatgaggccatctgtggtggctcctggacagcctcaggagagggggtgcttgctcggggaaccagtctggtgattggagtggggggactttcagccctccccctcccccacctccaggaagttgggggggtgggggtagaaggtggagtcgatcaccagtggccagtggtgtgtcatcagtcatgactacgtaatgaagcctccataaaaccccagaggcctggggttctgagaacttcctggttgctgaactcatgggggttccccgagggtggcacacccagcgggcatgggagcttcccggtccccttcccacacacctcaccctgcacacctccatctgccgttcctctgtgcccttgtcacagccttgataataaacgggcacgcgtgagtaaagcgtttcccgagctcagagctgctctggcaaatcagctgaacctggagagggagttcctgctctgtagttggtcagaagcgtaggtgacagcccactacttgcgcctggcatctgccggggcgggcagcctcgtgggcctgagccctcagccctgggatcctgatgctgcctccaggtgggtggtggcagggcatatgccaggatattataggatgctcagtgtccgccggagcatcgtgtgacgtggggaaggagagccactttcccatcctgcatcagaagtgttctgtgagagtaaagactgtttttttatcagacaactttttacattttcttctgaatttagatagttgatcaggttcaccctacagcatgaagcggtgattgaataaataagcatgaaacatgtgcctgccctgaagacgtcggtgtgtgtgtaactggcttttcttggcctcatgaagcaaacgtcttctcgctccatgtgaagatgctcagccagactttcttttcggggaagctgggcaggacagagcttttcatttctccacagtgtcatgggcagatggggagaaaaagttcttaagactgacagggacccactgggcctgtggtcagtgatcccagggtgagactgcgaccgcatgtcctgcctgaatttgcggacgggctgtacaagtacagggtccctggggccggcctcgtgccccccacccccaggggccgagatgctgcttcccggaggattggagagcgcacagtaccacatcacatcacacttcccaacagcccatcatctcagagtcacaccaggcccgtcctgatcacttctgaattctaggtaataaaaaatggatgatcctcaatattaccaattatttcacttggtgcaaaatcccatcacctggaaaaaaaagcacattaagcaggagcggaatgctgcaataatgtgaaactgctgtgtgccgcagagtgatacacactgttattaacacgggccacatatgttaatggggattctcaaacaatgaagtcacttgagtaactatttttaaatgttcattctcacatgttcttcttttggaaatagggccttttaaaggagataatgcctacaaagtgatttgttggactagaatctattaagcaaatgaaaagtacagaatgtaaagggtgaaagaaaaagcagccgaatgatggaaagctggatagtaacaagaaaactcagcatttgctggtttccaaatgagctaagcatgctcaggttgtcaaagggctgcatggagaggaagccagcccagtgccagggaccttgttttttctctgtttgaccgaatcccaaaccaatgcatcgtgagagacgtgtcttgagacgagatgagcagacacccccagacgttcagggactaggcctggtcacagcctcccagtggtgaggacggcacagaaacctgtgttctggtctctgtgccgggctgtgtctctagtgacatcaaaattcagccacagaacgcatagggagttgaggaggccgacaggtagcacggcatttcccagaaacgcaggatgagccccttgacctctagggctttgatggtgggagttgaagttgggcaggtccattgcataactccccttacccatccctagcatctccctgttgcttaatcagagctgctgtcagggcagattgctggaggtcaggagtttgggaccagcctggccaacatggtgaaaccccgtctctattaaaaatacaaaaaattagccgggcgtggtggtgcatgcctgtaaccccagctactcaggaggctgaggcaggaaaatcacttgaacctgcgaggcggagattgcagtgaacccagatcgcgccactgcactccaacctaggtgacagagggagactccgtctcaaaaaataaataaataaaaactgtattggtatattaatccttttctggaactctcaagtcaatcacgaatcccttctttcaagcctaaagggcttctccagacagctgtccaaaagcggctctgcacgtctgattgcagtgattggggttgggaaggatgcatttggagtcacctgcgggtgctcggtgagggcctggatgttgatggagtagggacctgaggttcccaggctaaggaggtgtcttggaagccaagtgaagggagtgtttccagaggatggggtggtccacgtgtcacaggctcctgccggcaagctgagctctgtgtggggtcctgacaggttgcagacagctggaggagagaggagacgccctcaagggactcacagaaaagaggaatgcagggcaagggaggtttccacttttaagaatggagaagtgaaaataagcttcttcctgaaagtctggcatcggagtaaagtgacttttttttttttttgagatggagtctcactctgtcgcccaggctggagtgaagtggcacgatcttggctcagtgcaacctctgcctcccgggttcaagctattctcctgcctcagcctccctagtagctgggattacaagtgcccgccaccaggctcagctaatttttgtatttttagtagagatggggtttcatcatgttggtcaggctggtctcaaactcctgacctcaggcgatctgcccacctcggcctcccaaagtgttgggattacaggtgtgagccactgcacccggccttttttttttttttttgagacggagtttcgctcttgttgcccaggctggagtgcgatggtgagatcttggctcaccgcaacctccgcctcctgggttcaagcaattctcctgcctcagcctcccgagtagctgggattagaggcatgcgccaccaccccagctaattttgtatttttagtagagacggggtttctccatgttggtcaggctggtcctcaactcccgacctcaggtgatctgcccacctcagcctcccagtgtgctgggattacaggcatgagccaccacgcccggcttttttttttttttttttttgagacagggtctctctctgtttcccaggccggagtgcagtggtgcaatcatggctggctgcagccttaacctcctgggatcaagcaatcttcccacatcagcctccagagtagctgggactacagacacacattacacccaattacttttttattttatattttgtagagtcacggtctcactatgttgcccaggctggttcaaattcctggcctcaagtgatactcccgcctcaccctcccaaaacactgggaatacaggcatgagccactgcacctggtcaggaatttagtagagatggggtttcaccacgttggccaggctggtctcgaactcctgacctcaagtgatccactcgcctcggcctccccaagtgctgggattagaggcgagagccaccacacccagccatgtgactattatttttgtgggaaagggctggattcctgacctagctctctgtgtttggtgaaggctggggtttggatttagtgagtcaaaagtgaggtgtaaatggtgcagatgcttttactggcccttacacacagcaggatcctgagcctggcaagaggatgccattcagggagaaagaagcctccaggtcctcactgttagcaaagcctaaggggtaaacagagggggctgtgaacttggaggagaaaaagagggagtggaaaaagccatgcatccacacggctctgcaggacttagggccaggcaggcccaacccagcatgaatgttcgaggccatgggagccagccctcctgtgacatagccacctctcagcatcagagaagtagatggctgctgtactgggctgactaataatagccccagccttcatgtccatccagaacctgtgacctcatttggacaaagtgtctttgcagatggaatcaagttaagatggggccacactggattcatgtggggcctaaatccaatgtgactggtgtccttggaggaagggaattgggacctccttaggggctgtcatcctgcctgctccagtggcacagaaaccaaactttgctgcctggcagccaaattccagggtgttgaagccacctgcgtgaagccctggcatgttgtcacaggagaagctcatcgtcaatcaacaatgccttcctcacaaagctggtaagaatgctaaaactgctccctccaggaccggcagtgctaatagcttataaaattaaacttctttcctacagatctagacatgaaattttattctttatattactgcacaaatttacttcatgggtacagatacggacatgaacaaaattaccaactttagagaactgaattaagaaaagagccctccccgctctgaagtcatccaaactccccgagcagagaaaacaagccccagcgggccaccttatttccttttcattttttggtctaggactttaatttttctacatcctgaacacaaaagtcgtatgttcctgaagtcagaaaaaccgcaatagcccatttatacccaccagaagttaaacctgtgctctgcgtgttaaggctgatgaaggagcacttcattacgccactcaaactggaatcccatctccgccgggcagaagctcttctggagagctgcttttcatgctcacactgcaatttcacatccatcagggaaatgggaaagaggcactcggagctgtcactcagggatgggccacaggatttggaccgagagtcctttctggaggggcatggccttctacacagaaacctacagtaggcgggaagacgccgtgagatgggacgagggagtgagtgtgcgtgggatgggcacaacttgcctcgtgagcaggtggacccttgagggctggtgcccaggaccactcctgcccagcaccaaccactgagccccacccctgggccctcgcacctccccatgcccaggccaggaaatcgtcccctccacataggtttcttggagggattatgaggttggtgggctggggaggggcgcccatttgtagatgcctgatcctgctcaggcactttgcagcatttgaccaccagtgtggatggtgaccaaagtgaaaacacctgctccaggagccagctgtgccccctctccaagctggagcagtctccctgggccaggaggactcgcctctggcgttttttgccagcagcctccgggatcccctgatgatgctgtcagcattcaatttggcggatttgtcacccactgagagcccctcatgtatttattttattttattattttttgagacggagtctcgctctgtcacccaggctggagtgcaggggcaaaatctcagttcactgcaacctccgcctcccggggtcaagcgattcttgtgcctcagcctccgaagtagctgggattacaggcacctgccaccacgcctggctaattttcatatttttagtggagacagggttttgtcatgttgtccaggctggtcttgaactcatggcctcaagtgatctgcccacctcggcctcccaaagtgctgggattacaggtgtgagccaccgtgcccagccaggagcccctcatttaaaatgacctgctggccagtgccaggagccctgccctaagcaagcgcctcacagggtccttcacccaaggcagcctcttaaagtgagttagtgttgggagcaggcattagatcatgagcttgttctccattaaaaaaacttactaaattgacacaaattgtatatattaatatttattgtgtaccacacattcggaaacgtatacatggtggaatggttacatcgagctaattaacgtgcattactgcacatattttacttgtgattaataacacttgagacctctcatcaatttcaagaacataataccttgctattaactatagctgtgttatgcaatagatctcttgaattttttccattttaattaactttgggttaggattcagaccagctttgctgtgggctgaataattaccacccccgcccccaacccaaggtgtcctgccctgatcccggaacctgtgattgtcacctcacatgacagagggcatctttcttgtgcgattatgttgatgctgtggagatgagcagattgtcctggactagccaggtgggccccaaggtcacaaggctcattatgagtgaaagacggaggcaggaggtcagaatcagaagatgggaggacaagatccaggtgggagtgacgtgctctggaggagggaggggccacaagctcaggggcttgagcgcctcaggggtttgggcgcctctggaagctggaagaggccgggaaataggttctccccctggaacctgcagggggaacacggctctgtcagcacgcttgattttagccagtgtgttaattcgttcgggctgctatgaccagaatattattgggacggcttcaacaacaggaatagattcttcagagtcctgggggctgcggcgtccaaggtcaaggcactggctgattggatggctggtgaggcccctcctgatttgcccactgcctgtttcatgctgtgtcctcacgtgaggcagagatcctctccttcctatcccttctcataagggcactaaccccatcacgagggtgccaccctccaggcctgattgcctcccaaagccccacctcctgataccatcaccctggtgactgggctgtcacataggaattttaccaggcacagtgtctggagtgaccagtgagtcccatttcagactctgacctccagaactgaagaataatacatctgtgctgttttaggccaccaggttttcgatacttcgttgaagcagcaataggaaatgaatggaggatattggtttgaatgtagtaaaacttccaggccgcactcacgtgcttcgtcatgtttttgaagctacagaagtaagtgatcatctcacagccctaaggtagttcagcattctctcctgggtcttttgaatttggggaaaccagggactggttccctaccccagctcccccgtaggcagcatggtgaagctatcctatgccccagggctgagatggggcacgaagttgaatggagtgccaaaaatcttggtagccaggataaaaaatatttaactcaatattttaaaaactcaaaattaatgcaaaaaactccatgatgaacaaaaggctgcaacagtgaacacaggcaggactgtttctgccctttcagactcagccgcccccacctctcctgccaggccctgctgcacgtggtcactccgtttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacaccatgctgagttcaaatcgactcattcacaatgaatcataataacatcggaagcaatgccaagagagtcagagaggccgggcacagaggctcacacctgtaatcccagcactttgggagggtgaggcaggcggatcacttgaggtcacgagttcaaggccaacctggccaacagggcaaagtcccgtctctactaaaaaaacacaaaaattagccaggcgtgatggtgagtacctgtaagccaagctactcaggagattctcaagtctccgctgaggcaggagaatcacttgaacccaggaggcggaggttgcagtgagccaagatcacaccagcgcactctagcctgggtgacagagcaagactccctctcaaaaagaggaaaaaaaaaattagccagacatggtggtgagcacctgtaagccaagctactcgggaggccgaagcacgagaattact

SEQ ID NO: 57 - DNA, 1716 bp, Homo sapiens
ccctgcccagccccagcctcttcccctgccccagtccctgcctctgaccgcggagggagccccttgccccggggggcttctgtctagtgccgaggaatcccgccagcaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaa

SEQ ID NO: 58 - protein, 429 aa, Homo sapiens
PAQPQPLPLPQSLPLTAEGAPCPGGLLSSAEESRQQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGISKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 59 - DNA, 1713 bp, Homo sapiens
aagcactggggatcacatttcttcatgaggtttggagggtcagatatggaaaccatggcatgtgagcagtagggaaggcgactcttaggcttttgcctaagtatctgttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaa

SEQ ID NO: 60 - protein, 395 aa, Homo sapiens
VSVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGISKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 61 - DNA, 2843 bp, Homo sapiens
tgaagcccagggcagggagcacgggggcagcctgagcaaacccgcctggagagcagccgccgtctcagtgtgagttttggctgcctactgggccccaccgaagcccgaagagggccaggctccggcttctttgtttaaactcccttagtccgactgcctgcagtggctcatgcacgtaattccaacactatgggaggctgagacgtgaggaacgcttgatgccaggagttcgagaccaacctgagcaacaaagcgagaccccatttcaaaaaactgtttaaaaattagccacaggcagcggcgagcgcctgcggtcccagctacccgggaggctgaggtgggagggccgcttgatcctgggaagctgaggctgcagtgaggcgtaaccgcatgactgcgctccagcctgggcgagagagggaaaccctgtctcaaaaaggcaaacaaaggctctcggccgccaagctgcggaatcccaagctccccaagacacgcagcgatccagaataccggccacctcctcgcctagtgcccggggcggggccggaagttccggcgagtggggcgttgagcagcggcgagcccgcccaatagggacatctcaggcccggcagtctcgcgagaagggcggcggccctgggttctgggacaggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaa

SEQ ID NO: 62 - protein, 575 aa, Homo sapiens
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGISKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 63 - DNA, 37234 bp, Mus musculus
  misc_feature (1)...(37234): n = A,T,C or G
cctggctgtcctggaactcactttgtagaccaggctggcctcgaactcagaatctgcctgcctctgcctctggagtgctgggattaaaggcgtgagccaccacgcccggctaaggaagggaattcttaaaagcacacacaaaagtaatttctcttatgataacagtttatcccccaaatccacatcgccccgaacgcagtggctttgggaaatgaggctaaatgggggtgttcaggttgtgtgggcttagccctcacgaacaggtttccagtcaccataaaaatggctttcgtgcggaagattcttccctgctcttctccacctgagagcagagtgtgccttaaagcaagatgctgccacgctggccttggccttcccagagaaacagatttctgttctttagaagtcacctgctattaaagtttgaatctaatatgactcggggcccttagcgtcctgattttttagtttggttgggttaggtttgggatgatagccgttgttaagacaggaatccatgtagcccaggctgccctataactcactatgtagtcacagagaacctgttccttctgtcttcatttcctgatatctggggttacagccatgagccactgtgcttgtctcatggcattctgggaaatctaatccggcgcttcatcatagtagacacgcactctactgcctgacccccaaccccaggcttcagggttatggtttgaatgtccagctctcaggttttggtgctgttctggtggctatggagtctttggctccaagatctggctggaaggaatagttcactggagatgggcccgtggttctgagccatttctctgcttcctgggatgccaacatgtgtgtggctccttgcccacagcgcatgctctcaccaccattacccacggctcgtgctcccaccaccgtgaacagacacctcgtcacactcctgttcccacagacagggttattctaccttttcttctaagctgaactgaagtgggtctcagagaccctgagctcaaataaaccctccttccttcaagttgcttcttcaaggtatttgtcgtgggtattattagaaaaacaacctgcctagtttgtgggattctgctcccagtatacaaagcacaagtcaatagagagcaaactaaagccaaggtcagagaaggctcccgaggaagaagcaagaataggtgttgactgtttgacaaaaaggcgggggaggggtaaaccagggagaaaattctgggcacagataataaatagtattagacaagactaaagacaggagcaaaaagggggacctttgtgactctggctggaacagagatccagaggggaacttgtggggtaggctgaggccttttggctactgggaggttatctcgaagctctttatggactggagactttccaggtaactttccaaggagacttctaggcctaggatagagtctgttctaaatgggtaagtgagatggcaccacaggtggaaggtgttctttcctgtgacccagcagtgtgccggggtggctcacacaagccctggagcgacttgtaccccatgacctagtgcttcaaggaagccacagactggctgttcataccctgagactggctgtccataccctgagactggctgtccataccctgagactggctgtccataccctgagactggctgtccataccctgagactggctgttcattctctgagactggctgttcattctctgagactggctgttcattctctgagactggctgttcattctctgagactggctgtccataccctgagactggctgttcattctctgagactggctgtccataccctgagactggctgttcattctctgagacttgctgtccattctctgagactggctgtccataccctgagactggctgttcattctctgagactggctgttcattctctgagactggctgttcattctctgagactggctgtcaataccctgagactggctgtccataccctgagactggctgtccataccctgagactggctgttcattctctgagactggctgttcattctctgagactggctgttcattctctgagactggctgtccataccctgagactggctgttcattctctgagacttgctgtccattctctgagactggctgtccataccctgagactggctgttcattctctgagacttgctgtccattctctgagactgggtgtccataccctgagactggctgttcattctctgagactggctgtccataccctgagactggctgttcattctctgagactggctgtccataccctgagactggctgttcgttctctgagactggctgtccataccctgagactgactgttcatatcctgaaactgggtgttcataccctgagactggctgttcattctctgagactgactgttcataccctgagactgcccgttcataccctgaaactggctgttcataccctgagactggctggtccagccacacagacctgccagccgccctgccccagacactgagaacactttgcagcacagttacttccacttaatagccctacctaaccgcaggtctggtatttggtacccatagcgccagccactggttacagccaggggctgtgatctttgcaaatcaggaagaagttaatacttggggctttccatctggattgcccttggctgtctagaaggtgaatagcagaagtctaaaaaccacaggtcttgagggcagacagacagggtctaaattcagctgtcattatacttagctgtgtgatatataacccatgagttccaccagctaaagggaaatattagcactagtcactgatgaggttacagaagcaaacgttaaaacatctgtcctatagcatcctgtagcaccgcagggcaacaaggaccaataaaaagtgccaccaacgtttatcgataaggtgacatcagtagaggtgctgggaatgtggctcagttaatagagtgcacagacccctgacacctctcaggtcaggcaagcacatgctgacagccccagctttctagaggtggaggcagggggattggaagttcaagatcatcattaggtagaattggtttgggcattctaacttatccagactgtggccacaaaatatcctttcaaaaaccaaggcatgtggacacagtttcctaattgaaatgattttgtgggtggggaagcctgggagaacttgtaggcagatctgtggggaaagagccagagacggaggcggggcattcgacttagtaaatagagacccctgtcccctcggccagtctcctagcttggcgggcttctaggtctgaaaggtttgcagggtggagaagtcagatcgtctaaggaggggtaagacactaaactcttcccactctcgtccatgaagcagggtgaagcagggctgcaggacctgaaggcagaaattctacaacagtttgtgtgtcccaaatgtctgtcgccctggctgaactcagggtaacttttggatccagcaaattctgtgaaaagtcatctctcccaggagctggtgagagagacctgaactgagagccaggtgggacccagcgttgggtgttgggtcaggactgaagctcaggagctcctctgctttgtctggtcctcttttgtaggttttgtcccacctgaccagctgtcaccaatgcccaggcagagaacagagtagtgacccaggggcagtgtgaccggggagtctgacaggccaggttctgaatgggactgggtctgagtcttgcaccttccagctcactaggctctcagaaggaagtttccacatctgtagagaggagagaaggagaagggggggagggaggagggaagaggaagagagtgtgggaggggannnnnnnnnnnnnnnnnnnntgaatttagaccctgtctgtctgcccctcaagacctgtggtttttagacttctgctattcaccttctagacagccaagggcaatccagatggaaagccccaagtattaacttcttcctgatttgcaaagatcacagcccctggctgtaaccagtggctggcgctatgggtaccaaataccagacctgcggttaggtagggctattaagtggaagtaactgtgctgcaaagtgttctcagtgtctggggcagggcggctggcaggtctgtgtggctggaccagccagtctcagggtatgaacagccagtttcagggtatgaacgggcagtctcagggtatgaacagtcagtctcagagaaagggcagggggtagagaaaggaggagaaaatgttgattcttatgtcatgacaggggccatgagatggactggaaagcgaagaaaatgaatgagaatagtttcagacagctgtcctggtctccttctctgaggagaaccaagattgtttacttagggaccgtggaagccacactcctcccgttgactcctccatccccaaagcttcctgtcctctctaacaagccagtgcttttgctagccagctctcagtcagactcagtaagtaaaaccttttatttctgaaacccctccaccttcagggttgtggatccacacagctatggttagttttagaataagagtgacctttctcatgggaaaataggacccgctactttgtatacagatttaattttttctaattaaaatttaaaaacatgattagagagcagaggcttttaaaggaaaaggctatgtgaggtgctgacacaggacaacaaggcaaatgaaagtgtgtgggtgacagagtgagttcagggctaacctgggctacttagtgagacatgacctccagggggcctgggtggcagtgtgcttgcctatagcatgccttaggcctttgattcaatcctcagcactgtcaaacaattttttttaaaaaatccttttggggctggagagatggctcgggggctaagaccactggattcttttacagaggacttggggttcatccacttggcggctcacaaccatctgtaactctagttccaggggatccaataccttcttctggagtctgtaggtgctgaatgcatgtggtacgtaggcatacatgcaagcagaacacagtgccaagcagatcaaagaccttgacataaaaccagatccactgaacccgataaaaaagaaagtgagggaaagccttgaatacattggcaggagtcaacttcctggagagaacattaaaagatcccaggatcagcagttaataagtgggactgtagagggattttaatccagcatcatggctacctttaatccctctggctggcatacagacatgcccttagacctcacctttaatcccaaacaacgaaagcagttagtttgaagcaggaagcacccatgtttgaaagtaatgtctaattgagaggcagacagagtgacgaatcagagaaagacttgacagaataggacacgcccaactctcacgagaacagagagcaaagagaagctacggaagacagagcagctctaggagagagaatggagaggggacagatttacagggacagtggtacagaggcaggctgcagagagagagagagaggacaaactagacacaggtgaagacagaactgactagagagtgagaaggagtcagaagattagaatacattgccagagttagtatgaggccaagcagagcaactcagtcagaggctgaaagaagccagtctgaatcagccagtatggagaggagttttgagtcaggacagttaagttgaccaaccagagttcagaaagagctagaaagggggagcttgttcagcagcaagtctcagaggctgaaaacagtctagacccagataagattgtatggagactagaagcttccaggactaggcctaggttagcagatggaggccttggagatgacaatgacatcagacaaataaaagatacttttacacaggtcctcatgggactgaaaaagcaaaggacaccgtccatgggacaaaccggcagccatagaatgggataaaattctcaccaactccacatttaacagagggctcatatccaaaatacataaagaactcatgaactagacatcaacaaaccaatgaaaaaacaggatgtgaatctaaacagagaattctcaacaaaggaccctctcgtgaccgagaaacagttaaagaaatgttcaacgtccttagccatcagagaaatgcaaatcaaagtgatttttgaggtccttcttacacccgtcagaaaggctaagatcaaaagtacaagtgacagctcacgttgacaaggacatgaagcaaggggacactgctccattgctggtgggagtgcaaacgtgtaaagtcatcttagaaatccatatggcagtttctcagaaaattggcacttgatctacctcaagatccagttatcccactcctgggcttaaatccaaaggatgctccattccaccacaagggcacttgctcaactatgttcaaaacagctttattcataacaggcagaaactggaaatcacctagatgttcctcaacggaagaatgggtgaagaaattgtggtacatttacacaatggagtattattactcaactgttttaaaaaagaaccatgaaaatttcaggcaaatagatggaactagaaaaaaatatcatactgagtgatgaaacccaggcccagaaagataattgtgatatgcactcactgataagtgtacactcgctgtaaaggatgattgtgctacaatccacacacccagagagactaagtaacaagaaggggacacaggaatctccccgggaaggggaaatagatttcacaggtggaccggagggaggggcgtgggaatgggaagagaagagatggggggggtaagagagagggagagagagagagagagagaactgggagagatgactggaactgggggacacttgggggtgaggtagaaacctagtgcactgggaatggccaggaatctacgagggtgaccctagtgaagactcctagcaataggggctgtgaagcctgaactggccattttctgtaaccagccaggccttccaagggaaggactggaacagcaacccaaccacaaaaccttcgacctacaattcctcctgcctgcaagatgtgctgggataaaggagtccaagaaattctgggattcgccaactaatgaacctgagaggccaccagagggagcccacacctgacacggcctggagtccaggaaccagaggctgggtgcccagagagctgaggtagaagaaaaagtcaattaaatgatccctaatactgctctgctctgcttgtagactggagcctggcagaatcaccatctgagaggcttcgcccagcaattgacaggagcagatgcaaaaacccacagccaagccttaggcagacctcagggaatcctgcagaacaggggtgggggttgtaggagccagcggggtgaaggaccccaggagaacacagaatcaattatctagggctcaaaggagctcacagagactgaactggcaatcagggagtgtgcgtggatttgactcatgtcctttgtatacatattactaacttgatgttttcatggaactcctaacagtgggagcaggggctatctctgactcttttgcctacttttgggacccttgtccatccttaacatgagaggatgtgcctaatcttattgcaagttgatataccatgtttggttgatatcccactctttcctgaagggaaatggaggaggagtggatctggggagagggaaggtggaagggagggactgggcggaaagggggagatggaaacattgtcagggaatgtaatatatgagagaattaaaaaaataggtagaaatcaataaattagcattgccttttgagtgaaatagttcactactgtctttagagtcctcatctccgggatagtgttttgagtttctgtggaagagcaagcaaaagccagatttgtttttctgagtagcaagggagcacgtgagagtgatgtaagttgaatacagccgtgaacctgagcacagtgcagtagataacaagaaaggaattagctgcgcttcttgtctctataattagccttttgtttacttcaccattaacctgctcataagaaacagtcattacttggggaaaaaaaatgtaaagaaaaaaatcctctttactccaaaataatggccattactgtagagggagatgtctagatatttctctctatgatgtctaggaagacatagctttatccagctttttgctccttttgttttaattgaaacaaagtcttgagtagatcaggctagcctcaactgaatccctataaagctgagaagcagtggtcttcacttcaaaataagagtcctgggactccgaattcgtttggtcttcatttcagaataagggtcctggagccccagcagagaatcagtttgtgttgagaacttgcaaagtagagtcagcccagagaaaaggcaaacatgtttggggcaccaaatgtgacacaaaaatggtttttatgcccctaatctcatttctcggctctctttggttcccattggctgaattcttcagggagctaaaatctacctgctgtctagtattgtccccttccggaattccttatctaaatggtacaggacacaaacctttccttttctgatatgtgagcttacaggcgggcagactacctgtaactttcaaccctagaacacactgacaatacctagagaagcagacaccagctgctaggcagaggaaaaaggggcctagagcccctccaccatctctgacgagccctaaacacaccttatactgaaaatggatcataatgattgatttcttacatagccaaggttaaccttgaactcctggtcccccaacctctatcaacccagggctgggattgcaggtgtgtaccttaaaaagctcataattttaggatgtgtttttgtgcttctcgaatgtagtttaaaaaatcccagacacctcttgttgtgctgggcctgaacagagcagagtttaaaaaaaaaatcaaatcaaaataactcgagttaaagttgggtccccagacagaaactaagctgtctattgaatcccccaggagatcaagagaaacctgagctaatggcctgctttccaaaagtccagcttttgttctttttctatcttgtatgtattctgcaacaattccatagagatatcaatgtacctatgtggtatccaccccaactccccattcgcactccgtgcaggcaaaatgcagaagatgaagtccataacccttaatccttacacacaaaaggacacacacacacacacacacacacacacacacacacacacacacacacacacgttgttgtcctagccttgtcccgactctacctataaggagagtaatttagaaagatcccgcttccccttccgtggtttcgcaggtttctggtttcggcccttctgtttacaaaaccagcgtttcccacttggctagttagaatggtttgtgtggtggaatgaagtgtcccctgctccaggatagaaaacaaagcctgaagcgatgtcctttctggttagtagcgacacagaccgcgttgcagcttaggacagcctcctccaagcttttaccgcgatgtaggcggggagtaacaagcctgccgggaattcctgcagaaactcagtaagaaactcgcaagacaggctgggtgccatcccccgctccgcctgcaaaacgggagtcttgccagtctcctcgaactctaccctaggtgctatttactcctcaacggaaccccagaactggatttcttgtctgatttttaaaaaatgttactgagagccccgcccccacccacggcaggcgacgcggggcagccctaggtgaatccccaccggtggcaccgccggaggctcctcctccctgggccgccgcccttgtcacctgccgcccaggggccttgcggcgggcggcggggaccccagggaccgaaatgtggcgggccgaccggtgggcgcccctactcctgttcctgttgcagagcgccctaggtaagtacggaccgcggggaccgcggggaccgcgaagatgtgccacccacccgaggtcccgagaggggacttggtgctgggcctcagggattctgtacacttgccgcgggtttgcttggtcccagagtgaaacaatcctgagcttggacggccttttctggacgaaaggatcccggtttccttattccaggcagggccgggagttccaggcacagacaccggaaagcgttgactgtatttgttgaccgaatcccagagtgcatacctgattgacacttttaataggggacatacaggagctgccgggatccagctctggttgatctggtccctgctaggagactctttaacggggcattttctctctttgtctttcatctggtaagacagcggggcacagaatacccgaggccaggacccaagcaccgaaccccaattttccactcatcaacttccccagggaggaagccatgggcatacttcagagtcctagacgcagtcaaaggagcaggaagggttcttagagccgataaacaatcataaacgttcatattatttttggttgcttctttgtcctggccactgtgttctccttaaggttttcaacccagctgctctaagtggtagacagtcatcatttttaagtgagggaaactgaggctcagagcacttcataggttgctttagaagtaccccagaggggcacacacagggcagaggaataaggctgagccctaggtttgcccatgaccagtgctgcccctgccctgagcgagctcacagctctgtagcagtgtttttgagttaacgagggtcttgggggacacgggattatgttccatccctgacacaaactggtttagttaacattgatctctgagccgtgtctctttgatgatggctgtgggtaacaccttgccccaaggggtagtctgtcctgaggactgaatgacattttatacagtgctataccagtccctggaacccttgaagactctgtgaagtgtggcaactctgaactgtgactttccccatgtggccaagctcaaactttgggcctgtcctgctcatggatggctcacggatggcttaaaactaaggggcttacatacagagtggcctcttgctagacaaactggaagctgggtttaactgcggtgtctcaattatgcaccttcagggcacaggacaggagagaaaaagacacccacatctggggtcaaaaatgagggggcagccctggcgtgagcttgagctgagagaatcatgtagacttgggcttaccttgcctggtgcctaaaaaaaaaaaaaaaaatgtatgggtctccatggtgacccacgtgactgaattctccctgtgaccatgagctcccgtggggcagaagatgaagccatttccttctgttccctggtacacagaggaagataggaagcatgggttaaagctggtcgggtgtggttgttcctgcgtgtattcctagtacccaagaggctgagttaagagattaccgcacatttgagctagcctagactaagctgtttgtctctcccatagtcaaaaggggactggtgagatggctctgaaggtaagcgttcctgacattcaatggacagaatctacacgttagaaggaaagaaccaatgtttgcaaagtgagcttttgcctccacatagacaccatagcgtgcatcacacacatgataaataaatgtaaaaggtgattaaagcaggtggtggtggcacacgcctttaatccagcactagggagacacaggcaggtggatctctgaggcccaggtcagaactacacagatacacagagagactaaaacaaacctgcttaaaaaaaaaaaacaaacaaaacaaaaaacaacaaacaaacaacaacaacaacaaaaaaaaacagactaagactgagccccaggagaaaccagaagaggaggtaagctcagagctcacacctgacagttggcttgatctagatttgagcatctaagagggtcttggtttccccacctttcctgggaagctcatagaaggctcacaagtgctcagctcagctaacagcaagttacagccagatacaaagggtctgttgctactttgttgctatcatgagtgtcgcctcttagaagtagcaaggtaggctacctggaggaagtgccatttgagtagaatctttcaaagattagatggtgaactccaggcaacctaagaaaagacatctaaatgatggttcccacagcttcgccagcctattgggagctgcagaagatgttagacaggtggtcaggccacccagacaagtcatcaaacacctggataagaggtgggaactttattcttaaggcaaggagacagtaggaagcctgggcacgaagcaagcagctgaggtaataagtaacatagctagttatttgagaaagaagcaatagggttggagagatggctcagcagttaagagcactgactgctcttccagaggtcctgagttcaaatcccagcaaccatatggtggctcacaaccatctgtaatgagatctgatgctttcttctggtgcatctgaagacatcgacagtttacctacatataataaataaatctttgggccagagctatcgaggctggagtgagaagggggaagaaaaaaaaaaaaaagaagcagtaggcagaactacactcttctctcagaccaaggaaaggtagccagggaacatgccacagagaaacaatgccatcaaaggagtgtgagggaagccaaggggatggccagatgttgggaacaccatgtgcaaaggctcagagcagggagcaaaccacagggttcccgaagagccactggaaaaggaggaggaatggggaagagggacagccatactgggaagcctcttggaggtttcgataaagggtggacgggtaacctagaattccagcaagagggaatggtagagtgtccatccatcctggtcctcagcaggcactgtaagggagctgaccatggtggttttcacagtgaattaattcccttttcattgctagaggaaagatgggttgggactcagggtttcagagggtctagggcccaacgtgctgagaaaggcaaggcagagtggcttttcgctatagaagccggaatgtgtggtgagggttgctcgtctgggctggacccaaagcagagagaatgggctggatcaagggtttggatataatgctcaaaggctcactcctatcccaccagttaggtcccacctcctatgggctccacggctttcaaaatggtagcttagagcttcgggccaaccatttaaaccatgagtctgtgggaggcatttcaagttgaaaccaggacacgtaggatatgtcttgtgtttggcagaacgcctaggacccagttgtccagtccacaaccaggtaggtgctccttacagaagaaatctgtttatcctggcatgtcttccttggctctcgtctgactggcaggcattaggctcaccggaaggacctcaacacatgtaccatggcatacacatatgtgtcacacatgcacacacacacacatgtacatgcacacacacgttcactaataataaattcaaagttaaaaaacataagaaggaaaacagaatgcttgttccaagaatcttctggaattcaggaacggtatgtggccattcgttggctcctggcccatggcaatcgggtggaacccaccctcaggtgccagagttctcgtggcacagatgggacactgagggctggggacgagaaggggctgccattcagcagctggccggtgctgcttcctcataggtgccaaggaagtgaacacctgtcatgcctctcattcttcagctatttgtacccgtgccaaggttggccaagagctccaggtaaagtttatgacctccttctcttccacaggaaggccccgtctagccccacccagaaacgtgacactcttctcccagaacttcactgtttacctgacatggcttccggggcttgggagccccccaaatgtgacctatttcgtgacctaccaaaggtataggggagcctctgtgctggtgggtggggagagggaggagtgggtggggagnnnnnnnnnnnnnnnnnnnntgggtggggagatgaggagtgggtggggagagggaggagtgggtggggagagggaggagtgggtggggagacgaaggagtgggtggggagatgggaggagtgggtaaagatggaggagcgcccctgggctatctgctttccatgtggtcagcatccagaagttctctgggtcactgaaaggggcttgtggcgagtccttgcgaggagggggagcttttttcttactcactttacaccgtgagggaggaggggctttgggtggaggttagaggtggtgggtggtgggatggagagccataggcttgctggagatagggtgagtctctgtggagagttggagtagggcctgagtggagcggtgagggccaagtcaccaggggacggaaatacctggtgtctgtattagtcactcttctgttgctgtgataaaaacaccacaaccaaggcgacttatggaagaaagggtttatttcagcgcgtaggtccagagcccacagtggaggaagcatggtggcaaggggctggaataggaagctgtaagatgacagcttcaacagaatgtgaagagaggctagaaactttccaaggcccaccccagtgatgtccttctgccagcaaggcggtgccacctccccaaagagtgccaccaactggggcccaaatgctcaaaggcctgtgctgaggagggacatttttcactcaagccactaaaaagattgttctagccgatgggtgagggcgaagaagtggccaaaggtctggtcctgctccctgtagagcccagtcattgagctggacagagctactgggtttcttatgaccttggaagcccaggctgctactactaggctggaggaatccgaaaagggaagcccatctgccatctttcagtaatgatcggctacacccaacttaaatccttctttcgtttcccattcccttcccttcccttcccttcccttcccttcccttcccttcccttcccttccctcctcttcccttcccttcccttcccttccnnnnnnnnnnnnnnnnnnnnttccccttccccttccttccttccttccttccttccttccttccttccttccttccttccttccttctagtggtgggagtcaaacccaggagcctcatcatgttaggcaagctcgggaccactgagccacacaaccacccagcggaaggttttaaagatcagattctgtgttgtggctgcttggcctctaccaagctgacgatttttttaggtctttgtggcaaacagcggggtcgatcatggacatgcacgtgtgtacttgcatgtccatgttagaatgactgatgcattcatccaacctgccattttccacctaaatttgattctttgggatttgtgctaaatttctcctgatgacggtgtttatgctacggtcttagttgtcacggccatgggagagggtagcctttgaagaacctagaattactcattactcatttccttcatcctaaagtctgtctaaaggacagtcagcactacgtgtgttccctttgctctagaacagtgcatctcagctttcctaatgctacagcccctcatgttcaatacagttcctcatgtggtggtggtgacccccaaccgtaaaattatctctgttgctacttcataactgtaattttgccactgttatgaattgcaatgtaaatatttgtgtcttaggcaaccctatgaaagggtctttcgatacgctccctccaaagggtcgagacccacaggttgagagccactgctcggctctgctaattttgcaaggctgtgctgacgtctgtcactgattctgagctgacatctttaggtgctcacagtctctagtaagtcctggttcctagtctttttatttcaggaaaattttcttagtcatttgcataaagtcctgttccccaaacaggaaatgggtttgtgtagtgcacccccttttgtacctggctgatttaatgaccaccttcctggaatccatccacatcacaagtgtccattcattttcttcttcactactgagtagtattccagtcctgactggacttttttgtgtttctccattttcccctcagtgaatttttgggctgtttccaggtttggggtgtgtatcagtttgcaatggctgttacacactctttcattattcccccaaactcatgttctcacagacaaaggcatccactggtgtctcaataatcccaaaggtctttccttactccagcgttcgctgtaagttcaaagtttcatctactatctaaatcaggggtgggtgtgacttagactatgactcacaccgagacaaaagtactctctctcagtggacctcagaaaccacaggaagtcatgtgcctttacactgaaatggcagcacaggggtgagagatacacagccattcccagagggaaaatcaggagagtgacagatgccagtcaatcctggtaaggcagcctccagtaagattttttattttacagacgttctttttaaagatttcttgcttgagattgatgacatatgcctttaatcccagcacttaggaggcagaggcaggtagatcattgtgagttcaaggctagcatggtctacatagttatttctatctcaaaaagaaaaaaaaaaaagaaaagaaaaaagaaaagaaaagaaaaacaacaacaacaaaaacaagccaagcagtggggtggcacagacctttaatcccagcactcgggagacagaggcaggcagatctctatgagtttgaggccagcctggtctacagactgagttaaggacagccagggctacacagagaaactctgtctcaaaaacaaaacaaaaacaaaagcaaaacaagaaagtgtgtgtgtgggggggtgggatggtggtggtggtgtacccaattaagctactcaaattgatcctagcagctgtggtgctccatgctacccaccccaatcaatgctctgggttcctgaatgaaatgcacacacatacacacagcctttacattttgatacgcctaaaacagctcaatggctggccacttcctaaactccacatgactaatccatctccctctgatattcccaaatcattacttatgacaatctatattccctttgctgctccggactcagtcaggcagccctcttgaggctgctccagctcctacgtggtggccatgctctctgcctcgcaccttctcaggcatggcgtctttccttctccctgcatggtggatccccttctccttccttggtcccttgcccagaaatcctaaaagtcccacctctctgctctgcccagccattggctgccggcaactttatttaccaatcaaaaccaactgggggcagggtccctcagtgtcttacatgtggatgtgaggattctcgtgcaatctggggagcccaaattaacttaattcaagcagcagtagaccaaacccactacatttacccctttttgaccagttaaaaggctcttgtctctcagatatacattgaacacaattataacaattatgtaaattgtaaaatatgatatacacttacaatgtccagtctatcatatttggcaatttagataaattaccctatcatctaccctaacttaagagtttacaattctatacctgaactatgttttgattttaacttgcattattatctgaaaaacatcttttcaaatctagatcatctttcttaatgttaaacaacttaagtttgattttgagactataactagtcttcaaccccatcagagatctgagaacgaattaaatattacctgaatatataggaagcacaaaaacatagtttctaaaacttaaacaatttgtagaaacagttgactgcctgggcagaccccctatactcctcataacattggagcatctttcttcagccttctggtctggatcatctgacaaaccttaagtgaagcaagaattattctgaaggactagcttacgctgtcttggcagagctaagctgtcgatcccgcatcttgtgtcctttcctgaacagtattttttgtctgcagatgaattggggcaattcttgcccatgttaccttgccacaactggagcatctccacgtggaggttacaatgcccagtatcttctttgaactgtgaaaggggtactgtcaggagcaggcatgtctcgtagtcaggagatctattaataaatgagatgattgtaaatgccatgttctgtaactgctgtaggctatctatctatctatctatctatctatctatctatctatctatcatatctgaactgttaaaccttgactactcttagctatttactatttgaataatattgaaaacattttataataattaaatcagaatttaatatttccagaagtttactatctggcccttaacttgcactacttaatccccctaaacggtttgtaatagcagctatagaagggctgggtctgagccttgtattctcctatgtgttgcattggcacaatgcctatctaggagtgacaaaattaaatttaaatttgtatcaacacacaaggatttataccaatgaagactttaaacctgtatcaatttataaattctgtgccagtgtaagaaaatataacttcaattctgcatcaaaatttagagacttctaccaatgtaagattacagctataaaatgttttgtgtaagagtaaacttagtaatccatcccatttcttataatattactctatccctttctcctcccaaccccctccccttccctaagaagaaaggatggaggggaggaaaggaaacagaaatccccagtctaagctctctctttagtttcctctctatctaaaatgataatcatttccaaattatcccttaaaatgatgacctatctataatttataaaatagccataaccagacacccaaaaacaaggaataaggatgacgactctccacggcttcttcctgctgaataggggtgatgaatatatagttaatttttaaggggtagggagggttagaaaagctggcaaagtcggttaggcttaagaaagctagctttagcatgtgtgatccagtctttgtatgcttagaaagttcaaggtttgacagaagttctgactggatcggtctgaaaggctggataaactgaggtcattgggaaccagaagctagacctgaagctgttctgggaaagtctctggaaacagccgcaggaggaacggagctggacaaacaggtcatttcagcatccctgaggaggaaacttgccagagctgcatctcggtgtttcattctgcaaaatatgaatcttagaaccaacttcttggaattatagagttatttgtatgaattgtgcaaggtgcacaggtcagttaaagataaaattccactctttgtttgagcaggtgaaagacatctgtattttttttttgagtcagtttgatcgataaccaattgtaataagtcttcgctcttgccatgtgaaggatgccatgatggatcttaaggattcggtaaccaacaagatttaccggctaattttaactgaagttttggctagagacatgttgatgtcgaagccagtttcagggtgttcccctgtggagggatcagcgtaacaagttgcctgtcctgtttggtcttcttgatttttttcttttcttcatatggtcatgatccttagtgggtctccccctatcatgtctgatccatattactttggacgggatccaaagcctttccttatctcctgctaatacaaacacagagcctctctcccaaaaaagcaactcaaaaaaaaatcaccaaaaatatagattgattcaacttaacagcctcccttttctttaggcctgatttattttggcccctctcacagagtatttgtaataccataatcactacaactacatgtattctgtattttgataattaacacaactgacaacaattaaagtaatcttaaacaagtattgttatccgtttgagacggagctctttttttttttttgagattaaaagtctacattaatttatctgttgaaatagggctccttccccaagattaaaggagcacgctaccaccttcccaactgcccatttggtttttgtttcgcttctgttttagagacagagtctcattgttttcgtcttggctggcctgagactctatgtggatcaggttggcctcgaactcacagagatcatcagcctgcatgtgtgctgcgattcaagtcctgtaccccatgcccagcctctatttccatatttacatgagttccagggatagcacgtaggtggccagggttgtgtggcaagcacctttacctgtggaatcaacttcccaactccacagataacctcttaaaatgataagttaaaaaacatcagtggacctcagcctgttgatggtgctccagcagagtctgggtgacttagaggtggtaactatttctttctcatactcctggggtctacggagcccaggtcaggacactagcagatctggtgcctgaagaaggacctaagattataccttctcactgtgccctcctcaaatggcagagaggccaaccctatgacctcacgtgagaacgagacggagcatccgagcagctctctgaagccatctttactaaccatgttgtctctatgatgtaataaccagaaagttgggtttcagttccaacatttgtttggaggaacacattaagtctccattaagtgcctagtggcttcccatcacacttgggataaattcacatcctaactgagaccttacatgacaccacctcccagaccccctcatcccctatctactgggcctcaccctcccttacctaccaggctttggctctctggccttctggcatctctctggatatgcccaagtccttcccatctgtcccagtgtgctttctttccattactgagataaacatgacaaacaaaagcaacttgagaaggaaaggatatttttgccttacatgtccagatcacagttgatcattgagggaagttgggacaggaactcaaagcaggacagaaacctggaagcaggaactgaagcagagatcatggtggagtgctgcttactggcccgcacttcattgcttgctcaatctgctttcttatacaacccagggccacttgctgaggaatggtgccgcccacagtgggcttttctttcctgtatcaatcaatggtcaggaaaatgcccttgtctatgggacaatccgatggaggcattttctccattaaagttccctcttcctgggtgatcctagcttgtactaagtaaacaaaaactacccagcatgccatcccaggccttggttctcttactctcccactccatgtccatcaaccactttcctcttcttcttcactggggaattccatctctctggacttttttgagcttccctttgaaagtggtgactgtttttatcatttttatcactgcatctactagctgcagggttcatcttgtgggcgcgacaattgtcccttgttccctcccatcagctatgagtaccttggggaggcaggacctcatttgttgtgctttgctgattcattggtacctggaataatgcctggatatagattagttctttgacttccatatcctgaagatgctgcagtcccatgaagccctatggattcccctctgacatccgctcagcaccaaacatggcctctggcatacaataggtgaactacagatgcctgaggaaaccaacagaaaatatccactaagattagtgatggtggttccacgaaagccttgtgaggagaactgcagataggaaactgagtttgaggggaaatgccccactgaaggatccagagttatggagcggagaggcaggactccacacttgtttgccaatggctgcctggctgagcagatggacaggcagatgaaccaatggcatctggcagaagggtggggtttatatttgggcggccctctaaccgtggctcaccctcttctgtcgctccccaaccctagctatatcaaaaccggttggcgaccagtggagcattgtgcaggtatcaaggctctggtgtgtcccctgatgtgcctgaagaaactgaacctgtactccaagttcaaaggacgagtacaggcagcttccgcacacggcaggtccccacgggtggagtcccggtacctggaatacctttttgacggtaagtccggatgctgaagaagcgcttgctactcttgcaggggaccagcctttggttcccggtacccatgtcaggctataattccagttctaggggatttgacgcctcttctggcactcacatatatacatatatacatacatacaaacacacacacacacacaaaataaatattgaaagcaggtccttttaatgaagaggctgagtgagaacattggacagcaaaacaatcgtgtgtgtgtgtgtgtgtgtgttaatatgtgcgaatatgtgtttatgtgtgtgcacatgtatgcatgtgcgcttgcaggggtcattcctcaggcacctctttttttttccacgtagaatctcttactgacctggaacttgccagactgccttttccaggcaagagatccaaggtgctccactgtccctccgcctgggtctcaccatagacagccaggacagaatggatttatgaactcactcagagctgagccaggctgaggtccctgatcctcggttcttgtcagctaggagcctctccaagctgctgagaattcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgagacagcaggctggccgaatccagaacatccttggtgggggctctgctgctgtgggctttcttctcagcccccaagttcacatcttttgcaagcgcagaattcatttactccccccacccccatgtcaaggtcccccaaagttccctgttattacaacatcaaatcgagtcccaggacctccccggcagtgtctgaagcagagagtcaggtagcttaggtacggaccactcagtgtggtttctgggcacacagttcatctccacctctgagctgctgaggctgaaggaaaccatctgtgttccctgtgtaggaaggtaacaaaaatagagaagaccagggctttggtctgaatttgtccagccgggaaaacaaattccattcaggctgacattctgggacaattctccttgactcccagaaaagacctctgcgctcccgcttcttgaagttcccacttccagggcaggcttccttctccaccatgggccacaagcacctgtggccaaggagttttgccagcctctaccttgtcagcagaagtgaagtcaacagctttccttgacttcatacacacacgaccagatgccaatgtttctgtaatctctgaggtcccaggaatgatggggtctcctgtgtgactggagagccacccctgggggacacctggtgtcatgtctaggtacaccacgctgggttgctttctctggacatctttgactaacccatctccctacccccacctttcatctctctgggacagcaagagacagagcttaagttttgagaggttactatgtggtgtacacagtcccccatggccacccttccctacccagacttgacaaaatcagaaggatccagactcccatccaatacccacccactactaacagcatcctggcaacgcacagcttctaaggctctagtggctctcaactgctgtatcttgacccctacaaggtcacatatcagatatcctgcatgtcagaactttacattacaatccataacactagcaaaagtccagctatgaagtagcaacaaaactaattttatgagggtcaccacagcaacttattaaagggtcacagcattaggaaggttgagaatcactggtataaggtcttactttattttctaaaatagagttggtgaaggcttgggagagagctcagaagtcaaatgcttcagtgagccccaggctcagtgagagaccctgacttaaaacacgcagtggagttcagtggaagcatacactgactgctcacctctgacctctgcgctcacactcacaggcatgtgcacacacatagtcggacagtgatgcttccctcccagagatagtgggggataaaagagctataagaagcttgcagcacagacaatgtttgaaaaatgcaatgggatgctctctggaccggacagagacagaagaatagagactaggtcaccccgggtggtttgactggtccgattctgtttctgacagtggagctagccccgcccaccctggtgctcacccagatggagaagatcctaagggtcaacgctacctaccagctgccaccttgcatgccgtcgctggaactgaagtaccaggtggaattctggaaggagggtctgggaagcaaggtagggaaagcttgtgccgcccccagctgggtctcctccctgcttcaacactgcctcctgtacttccctccaagaggccttccatggttttctgactccagttagcccttgatggtgtgcagcacccatagcctgtgcaacatctcgtggggtgcaccatcccatgtcgcaggagtgttctccataggagatgaagctcaaggcgctttgcccttcaaggaacaggccggcaacattgtttcccacctcattttgaaaatgatgagccttacctcagtgggggcagggcacaagctggaggatgtgtgcaattgagtgtgccagtgaatatacctctgtgtgtgtgtatatatgtttgtgtgtgtgtatgtgtgtgtgtgtatgtgtgtgtgtgtgtttatgtgtgtgtgtatgtgtgtgtatgtgtgtgtgtatgtgtgtgtgtatgtttatgtgtgtgtatgtgtgtgtgtatgtgtgtgtgtgtatgtgtgtgtgtgtatgtttatgtgtgtgtatgtgtataaagtctcaccatgtagtcctggctggcccagaattcattatgtagacgaggctggcctcaaactcaaagatctgaatgttaggatcaatgtcccaccttatttctgaggcagggtctcttagtgaaccaggcgccctagattaagctagcctaactggccagcaagcccagagattatgatcttgtctctgcctccttagaacgggattacagacacgcccatcctttttatgtgggatcgaactcaggtcctcacacctgcgcagaaagcacctcactgactctctccccagctcttcctccccaacacctctagtaaaagtttgactgaagttgtttggactgcaggaagtttagtcaccagagtcattacaggaagccctgaaagtccaaatgagccctgagcaaagaagaagcgcccagagacgtccatgaatggctccttgcacgcccagcctcagacctgtgtctagactatagcaggagcaggcctgaagtctcatgttcggcagatcagaacaccaccagtatgtttgactctgtggctccagggtctgagctctgcggctgtaacttaaaagtagccgcttgtggatgatacggacaaaagcgtgtcttgcaggattcctgtttatgaaatcaggctgtgggtagcattggcatagcaggggctctttctcatttacgttcacacctctgattctagggatgtgaacgtgaggtgcttcctgccttccagaatctcgtgactattaacactgtatcccaccaacacatacaagttgttcaagactgggtctcattgtgattgtatagtccaggttagcccagactcaatccccctgcctcagcctcctgaatgaatgttgggatcacaggcacgtgctaccatgctccggttaaatatgaataatctttgtaagtcagtcagaagtcaatatcctaaccagcaccgtccagcagaaacaagagcatatatttattttggggtggggcaggcctgtatgtcacagcctgcttctggaggtcagaggacaactttgggaaattggttctctcctctacttcctggttcatctcactggagactaagtggccccccaagtcattttaaatgttccctgttaagttaaagctggctaggtttgcggggaggagaggtagttgagataggagttcctaaagcccaggctggccttgaacttgttctatagccaaaaatgaccttgaacccctgatcctcctgcttccacctcctaagtgttggtattgtaggcatgaaccacatggctccactttagtatttcgcctggaactagagatccccctgccttttatcccatggcatatacaaccgctgagctgttttgctctcttctactcctccacctttggaaaccgataagcattttgtactctgggtgtatctccatttgcactagtcacctaccctgcctgtactgcactgggcagctggggcactgagctgggtgactgagaccctcatccccgtggactgggaggcccgagggctggaaacctgtagaaactcctcctgaagcggggaccctccccggccttggtgagctatacaggagtgacccaaagtagccggcttcttttgaaccccaacgatctgcacgaggagattcggctgagaagaaaccaggttgtagaaaatgcccttagtgcttgctctacaatgtaagagaaaagaaagctccgtggtccctaccccacctcacctggccacttccaccaccggtatccgtcagctcagcgcatgctcattgccgcttgcttctccaaacagaccctgtttcctgacactccctatggccagccagtgcagattcctctccagcaaggtgctagccgacgccactgcctcagcgccagaaccgtctataccttaattgacattaagtacagccagttctctgagcccagctgcatcttcctagaggctccaggtgggtgcagagcagcactggagtggaacatcccctccctcctcccatgccactccggggacaccagaagtttcatgattgaatggttcaaagtataaactgacagacagatcgaaatcccagctctatcacagtgactgtgtgtctttaggtagcttacataacctctttgagacttggcttccactagaatggtcttattctcctgggattgagcaggactgtcaccggaaacactcggttcactgagggacggggccattgttctgtcagcagttactgtgttctttcctccctaggggacaaaagagctgtcctggcaatgccctcactcttgcttctactgatagcagccgttgcagcaggtgtggcatggaagataatgaaaggaaacccctggtttcagggggtgaagacgccccgggcactggtatggcatatctggagtgtctagaaggcatgatggggtgtatagaagtgaggtgttgagtagcaggaagtagggctaagtttccagtacttcagacagaatatcaaactggcccatcttgcctcggtgtctagacccccacttcagggggtggatacctttagccccaaatccactaacaaacctgccccgccccctgcccggagaaatacctaagtccccttccgtggaatcaccgaaccttctgctaaggcgttgtcaggtgcaaagaggcacacgcagccctgagacccagaagagaggaccagagtgtgtgggctgggaagtggtacagccgggagcatcttttaagccagcaaatgcttagtttacaacttaaccaaggctgagcggcaccaggccagtttcgggatgctaactcctctgtcagatccgggagctagctgggggaagggagaggcctagagaagttagacaggagctggaccacaagtgggcagtgagaggctttgaggacagactccctgtgtgtcacagcagggagtagtttcaaaagcctgtagagcctgcaaaactccccccgcccccacggtgcttggccctggtgttttctggaaacagctcccaaagaaataacttccacttgaagccgtgtggactattgctagggaactattgttattgccccaggctcaaccggtcatgcttcaagaagctggactcaccttctctcccttctctttcttacatcaggacttttctgaatacagatacccagtggcaacctttcagcccagtggacctgagttctctgatgacttgatcctttgtccccagaaggaactgaccataaggaacaggccagcccctcaggtcagaaacccagccacgctacaggcaggaccagaaagagacagtactgaggatgaagacgaggacacagactacgatgacgacggtgacagcgtccagccctacctggaacggcccctcttcatcagcgagaagccccgggttatggaacactcggagacagacgagtctggggtggattcaggggggccttggacatccccagttgggagtgacggctcctctgcatgggactcttcagacaggagctggtccagcacaggggactcctcatataaggatgaagttgggtcttccagctgtttggaccgaaaggagccggaccaggcgccctgtggggattggctccaggaggctctcccatgcctggaattttctgaggacttgggcaccgtggaagagcctctgaaggatggcctctccgggtggaggatttctggttccttatcctcaaagagagatctggctcctgtggagcccccagtttctcttcagacactgactttctgctgggtcaacaatcctgagggggaggaggaacaggaggacgaggaggaagaggaggaggaggaggaggaggaagactgggaatcagaacctaagggcagcaatgccggctgttggggcacttcaagcgtgcagaggacggaggtcaggggccggatgctgggagattacttggtcaggtgagctggccctggtggtccatctacacattctctactgcacttcccctggaccacagacacctccgagagtcatgtccctttgagtggtagccaaggtcctggccattcgtaatggatctttatggcactttgtcgttgggattgagttgtaagatgtcaccatttccaatgacccaccagctataggtgacctgtgagcgggacagagctgtgatcagagactagttgagttccaatctgcccattgtccctgggatgacgggcctgatggaaaaatcatcctgtgataaaatgaaacaggtgaagccaggtgactgtggacaccaagggtagatacgccctagtccataagtcacacacagcattgcgcaaaacagacctcggtccaaatcactactctgctgtttctgatagtcactgagcaagcgactcttaacctctcaacctcagcttccccttctgcagcagtcctgtgggtatggggaggtaacaggtgacacagggccaccaatgtcacatgtactgactaggcactagaaccctccatcaatccagactcctgggagaccccaggcatctctccccagcaactcctaagccaagagtgataagacatcgaccttccaacctgtctgccctctaggtcaccccatttcttccttgccaccttctattcaggggctcctggaaaccacagcccaaccaactttgcttcgttctcaagcatagtacaccttccagggtcgacattggttggttcagggcagaaactgcactcctggcctggtgtcctttttgaatggcattgtatcagggtttaagtttttttgggtgtgtttgtttgtttgtttgtttgtttgtttttatctgttttggctataatgaggttccagtatctgagaagctagtgtcttttgaaaacaggtgactgtcctttttggggtgtgatgtgtgtccttgtggctgaggatctaaacagaccatgaagcaggaaagagctcacagcccctttactctcggagctgtgtggctctgaggctggcataaagccatagccttacagaactcatgtgaagacccccccccccgtaaggcagaggttctcaaccttcctaacactaccagccttaaacagtgttccttgtggtgtggtgacccccaatcataaaatcatttcattgctacttcataattataattttgctattggtatgaatcacaatgtgttttccaatggtctcaggcaaccactgtgaaaacgtcaatggacccccaaaggggtcatgacccacacaggctgagaaacatgaccttaagggcatctgactcaagggttctctagctcattcccaaaggcctttggggctccaggatcctcactcttcaatgggagtggcctcactcagctaatgcacatgtagtggctttacataaaaggtgtcttgaaaggggttcacagctaacaaaacctcaaatcactgtccttggtacatatctgtattgtttcaaacaaacttggatgtcaactagcaaggctgccctagtgacttcatttgtgtgtccccaagagtccccagagtcaccaatctgacaggaggtctttgcaagcacctctgggacacacacacacacacacacacacacacacacctacctctctggggtttccctacaatgatgtttgaccacatcactgagcccagaagcagaacaaatgcacatgcgtgagggcggtcagagcacgggagaagcccctagaaatgtcccagcaaggccagtgtccttcctgagactcagctgagctgcaccacggaggatgctctgtcaggaatccttggaaatgatggtgatgacagcattggcctcgcctttcaagcttgctctctccggtagtccttactgtttacagtgtttcccaatgttttctttctgatctagccttcctgtcattcttaatcctagctcctttcagccattaggtcattgacagaagacctgtgggaagcctgtggaaagggcgggaggtgcaacccagaagttcataatgtgtgctcagcacttaacttacataatagccctgtacacagacagcctccggggacctcaaggagagcaagatcagagtgaccgcctggagtcagtgtggtgggcagcttcggcacactgaggctatacgtcttacgtgtttgtattacctgtcttgcatgtttgtatttttgtcgaaatcgtgccctgtattttataccctatttaagtaatactttaatatctgttggtataatacccaaaaccttaaataaagagatttatttttagagaaagctaatgtgcacgcagttgtttgggacatagggatctaaacttgtgtcctccaaaaggagacatggagaaagaggtctggggcatacagcttccagaggacaccataaggaagtgggggatcaaggcagggagaagaaggccagccagtcaacgtataaaattaaacaggtccctgatactggagatggggcctccacatccctgggaatcttctgatgtccgtgcctggcccatcagatttgattgtctgcaaagacaggagctgggggacgcatgctatgtggaggttgcctttggtttggttttgaacctggggtcttacacgtgctatgcaagcactgtacccccgagctgtatccccagctggggcgggggggggcgtcaccatgtagccttcaggggattgaactcctgtgggcttgcacacggaatgccttcggcttccacttcttatttttgagacagggtctcactaagttggccgtgctggctttgagctcaccctactgcccaggctgatcttgaacttgtatcttcctgcctcagcttcccgagtcgttgagggacaagcctgaaccaccaggcccagcttcttatgcacatgctgttgggatccacatactcagtatgagaagagtgagtgccgtgggtcctggttttcggtgccacctgggatggtgaggctggagcttgcccaccaccctgggagctcacccaatggaggcagtggttcacagaacgatgtcttggtgcggccagccttgcaaccctaaacttgctgcagtagctctccactaggttgggtgcccagcttcctgaggacaagtcatgattatgtggcatggcacctgcaggtgtcaccgtagactgccgccggtcagaccccagacacaggctgagcagatctaagtctctgcacttcagtcttcccggccagtgaggtcaggtgctacaatgccttccctcctctatatggagtgtgtgctccctacatctcagtctacagcaggaacgcagccattggagtgagaagccataatgtgcctggtgccacagaggccagaagagggcgccagattctctgaaactggagctgtcgtgtgggtgctagttatcatttttaacccaatggctttacaattcacaggcacaggcagggagcagtgcagtctgtgggcaggctcaggagtctatggcccacttgactgttacgcaatgagaccctagaaagcagggtaaaccttccttttctgattcccctcaaccactctgagctcctgggcctgtgtgctgccaccttctggacggtggtgggatggcgggactgtcagagaggcgtctcaaccaccccattcaaccctgctctgacaagaaagatattaaatggacactacatccaggctccagcacttgacccagggtgaacatctgacacttaataaataaatgaaagaagtaacaagacccctaggtaaaatggctgactagaaggaaggagagagtcatcagaataaggaaaaacagactttactccaaacagagaactagacaaagagtttcagaaagtcacaaggaggcgacattagaaaagagagggctgaaaataagagcggccggaagaagtgagcggaacacggtctcagccatgctgtcccctgtggggaaacggaaacagccacctctaaagcaagctgcctgagaaccgggcagccctgccttacgcccacagccctcaaaagcctcaaatccggctgctggattagcagtttggcagtggccagggagacggtattggtgattctgatggcctacaaataagcggcaaagaaatcctgtttggcagcaccatcctgagagagaatctgttggagagagagagagagagagagagagagagagagagagagagagagagaggagagagcaccaggcctactccagggacctgagattggggattgtccatgttagacagccaaggcttctccagagggcttagtcctatcaggtgccttccctaagttgctcatgtccaaccccaaggtggggtagaactacagaattcattcttgtgtttatattttattcctatctggtaccatcaccaaactgctaaactcagagaccctcccctctcaaacctataaaattatggaataccctgcactctgtgggctgctgttgaatttcccaggtaacccccaaaacattactaaaagctgatatccatctcagctaccaatcttttctctacggactctggaaggagtcttcattctttaagataatccacaggtccctgagcatcaacctagcctgttgtggctcctggggaaagagatagctctgggaagccagaggaccagactctgacaagccctagggctcagacagcaggaggctgggctcagactaggaaacatgggaggagagatagtctcaccctgcagctggtgacaagacacagcttatcaaccgagaatcaccctagagcagtggctctcaaccctcttaacgctgcaaccctttaatatacttcctcatgttgtggtgattcccaaccataaaatacttcattgctacttcatagctgtaatcttgctactcttatgaatcataatgtaaatatctgtgatccccccatcacccccnnnnnnnnnnnnnnnnnnnnnnnnnnnnnnnnnnnnnnnnnnnnnnnnnnnnnnnnnnnnncccccaccccgctcactccaggcccagctcaatccagtccataggtttttaaaatttgtttctcattacggatggttgtgagccaccttgtgcttgctgggatttgaactcatgacttccaggagaatcatcagtgctcttaactgcctagccatcacaccagcccatatctgtgtttttcaatggtcttaagtgacccacaaagagtctgagacccacaggttaagaaccactgccctagagtttgatagctctgatcttgaagccagtggaagcatgggattctgggccctgggcatgttcatttacctgtccctcctcgaggccaagaactctgaattttcagcccaggggtgtacatgatatccaacagcaacattcctcgatagaggtggtttaaaggaagctttggaaatacaaaaacgggtcctttgcccatgccaacctccgcttcttatattcccaacactctcgagagacaccccccagctagaacacgccccgtggatacaaagaaggaaatacattggtgtgtggacagctccaagggacatcagactcttgtctgggtcagactcggcaacagtatcaaccataaagaaactaagagtacactcaactggtcaaagtgttgagaataggtgtcgattgagcactcagccctaaatgagacgcctatgtctgaccctgcacctgaggctcaggggacacctgtagagacatgtggaaccagtatgagaactggagtggggaggggtgctgtgtaaagctgtctttgctgcgcaatgaactcaccgctgtgtaatgccctcgctgcaactcgaactcatggcagctttggttacctgcacaagatgaatccagcaagaccagccagcaggcagcactaagtaggtaattagcaggaagaggaggtgacaagaagaaggtagagagttagctggaagtgccccagggacaagtaggggcttagggatgcatgcgaccaagacacattatttacatgtatgaaattgccaaggaataagtaaaagtttttttaaacaacaacataaggagaaaggtttcaaaagttcagctgaccttctggtgtcacactggtgagtcttcctcctagagcctctatctctgcccggaagttctgccttccctccttgcttgactcagcctctgtctctgcccagaagttcccggaagctccaccttccctctttgcttcagccattggtcgttggatctttattaagccatcaaaaggcgagggaggaagactgtttacaaaatatgataccagtagggagctgtaagactgctcagctttctgcccgcacagaaatccacatttgaatagacaaagacaacctttacacagtacacaaaaaagatcacccaacaccatctctccggcctttactgctcttcttaaaattttagtttttatatgatgctccccttcttgcgtttatctgactttttctcccagttccctgcctccttcatgaatcacgtctgtggacgactcaatacaatcgcactgggatctcttttattcaagctcaggctaactcacagtgacccttatgcagcaggacgggcaggtgaaaccccaagtcctcagcaggacaaggttttataggaaatggtgaacaagcgagggggggttctagcttggcaagcatctaactgaatgactattgtaagctgacaggtgagtactctgaaacgaaaccatgagcaatcacagtctgaaaatacctttgaaacaatcagactaatcttgattggctgttgctaggaagtagctagggagtaactctggggtaccggccaaggacaagccatggggtccttcctagtactcgggtgcagcttgggttcagctgcaggtcaaattctcgggctctttttcttttaagatggaggccgattctgagatgaagaaggtttgggctctcaagtatactctacggtttcccatggtcactgatgtgttggtagtgggctgtcacctacctcattgctgccattacaatggtttgttttcctctcgccatgtgctgctgggaattgagcctccaacaggaggctgctcagggagctcctccccagaactaagtctgtgcaaagcatctgatgcaaaatgcacaacacagaaatgtaagaaagcagaaaagccagacagctggcccgcccaggagctcctagctccacagcagttgaactcagacatcctgaactagatcaaatgtcaggtgagcgattcacaagtttcctggtaaaaaaaaaaaaaaaaacctataagtgacctgaaagtgtgtaacacagacaggtgagtccttcccaggctgggagaggaaagtccacaacacctcctccatccctgataggttcccttccgcttcacctagtgtattggtgacatatccctctggtttattaaatttttcatttccaaattttctattttccctccaaatctcaattttcttgctgactttttcttccatgttgctgacttgctcactcatttttgctgacaagaaagaagctgcagaccaacttcaagactagtaatttattttatcttgtgtacgtgtgtatacctcagtgcatatctgtctgtgtatcgtgtgagtgtgtgagtgtgtgtgtgtgtgtgtgtgtgtgtgtgtgtgtgagagagagagagagagagagagagagagagagagagagagagagagcaagcccaggaaggtcagaagaggtttcagatccccttagagctggagtcataagaagttgtgagcctttgacattctttcagactgaggaactgaagagacggctccgtgggtaatgcatgaggaagagagtgtagtgacaattttggagcctcagtttctttgaaaaaacacagagacattataagaagactgtgttttcattttaatcccaggtgtgggatatggggccgcctcggagtgttcgcagc

SEQ ID NO: 64 - DNA, 683 bp, Mus musculus
gaccccagggaccgaaatgtggcgggccgaccggtgggcgcccctactcctgttcctgttgcagagcgccctaggaaggccccgtctagccccacccagaaacgtgacactcttctcccagaacttcactgtttacctgacatggcttccggggcttgggagccccccaaatgtgacctatttcgtgacctaccaaagctatatcaaaaccggttggcgaccagtggagcattgtgcaggtatcaaggctctggtgtgtcccctgatgtgcctgaagaaactgaacctgtactccaagttcaaaggacgagtacaggcagcttccgcacacggcaggtccccacgggtggagtcccggtacctggaatacctttttgacgtggagctagccccgcccaccctggtgctcacccagatggagaagatcctaagggtcaacgctacctaccagctgccaccttgcatgccgtcgctggaactgaagtaccaggtggaattctggaaggagggtctgggaagcaagaccctgtttcctgacactccctatggccagccagtgcagattcctctccagcaaggtgctagccgacgccactgcctcagcgccagaaccgtctataccttaattgacattaagtacagccagttctctgagcccagctgcatcttcctagaggctccag

SEQ ID NO: 65 - protein, 226 aa, Mus musculus
  VARIANT (1)...(226): Xaa = Any Amino Acid
TPGTEMWRADRWAPLLLFLLQSALGRPRLAPPRNVTLFSQNFTVYLTWLPGLGSPPNVTYFVTYQSYIKTGWRPVEHCAGIKALVCPLMCLKKLNKKFKGRVQAASAHGRSPRVESRYLEYLFDVELAPPTLVLTQMEKILRVNATYQLPPCMPSLELKYQVEFWKEGLGSKTLFPDTPYGQPVQIPLQQGASRRHCLSARTVYTLIDIKYSQFSEPSCIFLEAPX

SEQ ID NO: 66 - DNA, 49356 bp, Homo sapiens
gagcagtgaggcaggcggtctccaggtactcttatgggaagttctccaggaagttctgttgagtaaaatatcggaagcaggaggcataataactgagtatgacacaattcatataaaaaccacccacagggccggggcgaggtggctcacgcctgtaatcccaacactttgggaggccaaggcaggtggatcacaaggtcaggagtttgagaccagcctggccaagacagtgaaaccgcgtctctactaaaaatgcaaaaattagctgggtgtggtggcgggcatcccagctactcaggaggctgaggcaggagaatcgcttgaacctgggaggtggaggttgcagtgagctgagatcgtggcactgcactccagcctgggtgacagggtgagactcagtatcaaaaaaaaaaaaaaaaaaaaaaaaaaaaaaaacacacacagggatgtacagtatgatgtattttctatgggcctatagaaaaagatttgaaaatattgctcccaaactgataataataatgattacttttgagagggaggggagaaaggataggggaatgatgaatcagtgctattttaatgtgttgaaaggaaaatgaattcatcgattgcctgtgtaatttaaaatttattattagaaagacagagataagaagaaaaataaactttttttttttttttgaggctgagtctcacactctggcccaggctagagagcagtggtgcaatcctgactcactgcagcctcgacctccctggctcaacaaatcctcccacctcagcctcccaagtagctgggacaacagctgcatgccaccacacctggctaatttattatttttgttgtagagacgggggtctcaccgtgttgcgcaggctggcttcgaattcaccggcttaagcgatcctcctgcctcggcttcccaaaatactgggattacaggcgtgagccagaaagaattttctaaagggaggagaatcacaggaggatgtagcacacagtagtaggcccacaaggtccaacgggtaggaccagagtccccaccgggcgtagaagagtcccgtttgtgagctagggctgggctcccagccaccgagctgccaggcagcaggttcgcgcacgctttcccagaaaagtctgggcgcgcaccgtgcctgcccctgcaagcccggcggccagtgcgcctgggaaccgctgtcaagcgccagcggccttcccaggcctggaaggagcagataaaggcggggatggaaagagcctagctgttcttacaggaaagggagagggggttcttggataagaatggccctcgcctcctctcccgcttcttctgcgcctttgctccctcggatcctttgagcagggccacacttggagtcctccacgccagggcctggagggaatgtcccacccccaccacgcctcactgcccgctgagacagaaaaggctggcccgagatgaagggctgagccaagatctgaaatcacaggctgtttcctaggctgccacatggccttgggttcaaatcccagttctaccaccctcaaaactttgcacccctagagaccaccccgcaactgagatataattcacatactataaaatccaccattaaaaatgcacactttttaatatattcacaaagtcatgcaaccatttctactctctaatctgagaacgttttcatcacctggaaaataaactctacccactagtaaccattccccatacccctccctttccccagcccctggcaaccactgatatacaactgaccattgaacatgggtttgaactgtgagggtccacttatatgtgaattttcttctgcctcttccaccgagacagcaagactaaaccctcctcctccaccacctactcattatgaagaaaatgaggatgaagacttttatgatgactcacttccacttaatgaatagtaaatgtattttctctttcttatggtttccgtaataacattttcatttctctgtttactagagtacagtatatatgtaagagtgcagtatatatatatatatatatgacatgcaaaatatgttgtttatgtaatcaataaggcttccgatcaacagtaggctattagtagttaagttttgggggagtcaaagcttacactcaaattttcaaactcttctcttcacttctttacctatttgaatttcattcaacaattgttggaattaagtttactgtggagcaaaatggtggctgcctgctcgcgcgctctctctctctctctctctctctgtctctctcacacacacacacacacacgcacacacacacaccatttaataccggtctaagcccaaactggccgggtgcggtggctcacgcctgtaatcccagcacttagggaggccgaggcaggtggatcacctgaggtcaggagttcaagaccagcctggccaaaatggtgaaactccgtctctactaaaaatacaaaaaaattaaccaggcatggtggcgcacagctgtagtctcagctacttgggaggctgaggcatgagaattgcttgaacccaatcagctaagatcacgccactgcactcctccagcctgggcaacagagcaagactctgtctcaataaataaataaataataaaaataggggtccaagcccaaactaaatggaaaggtaaaatatatccaccaccccacatcatagtatgttagagctgggatcaaatactacagtgtttctgaaagtgtggaacccagactagcagcaccatcatcaccagcatcacctgggaactggttaaaatgcaaatccttaagccgcacctcagaaaaaaaatggaaccggggactctggagatgaaccccagcaacctgtgtcttaaccagctctccagctatggctcacgcctgtaatcccagcacttcgggaggcccaaacgggtggatcacttgaacccaggagttcaagaccagcctgggcaacacagcaaaaccaagtctctacaaaaaataaacgaaattagccgggtgtggctgcatgtacctatagtcccagctattcaggaggctgaggcaggaggatcgttgagcccaggagattgaggctgcagtgagccgtgatcatgccactgcactccagccaggtgattctaatacacatgaaagttcccaaattacagatgagaaaactgaggcccagagaaaggatgtaactttctcaagaccacagagtgataaagaaaggaagctttggaattgtgtggtcctggatgtgagttccagcttccccatttccacctgtgtgaccttgggcatgtctcttaacctccctttactttagtatccttatctgtgaaatgggaactgtgtatacctccctccaagcaaggccacttcgctgcattaaagccggcgtgagggctggaactgaggtctcctggttcccaggctggtgctcttacaccaggaaactggctgtcatctgtgcaccatctacaagaaggatcttgagacttaacatctgtaaaggctggcatggggagaagggctttgttttcttctgtgaggccccaaaaggaagaattagatgactagggtaaattacaaggaggtaggtcaaagtaagggcgatgttcctaactagaactgttcacaaacagaattggcagccccaaaagatagcaggatctcgtcccccaatgagtccaagcagcagcatccagctggtctctccaggatgttgaagagggtagactttcagggtaggaagttggtggggatgatctctaaggactcctcctctgcaatccagcagtgggtgtatgccgtttgcctctgcagcctccattcctctgaggaaccaatcttcctccagttcctatagttggaggagctgtcaatcagaatactcccttacccctctcccccgggatgggcattctacccagagaggccaatgacagtagcccattcttctgaccacatcgattggctcaggaaatggcatgtgacccaagccaggccaatcagaatctgtttccactagagccgtcccagagccacatccatccttgaacttctcaatctggggaacttgcagaattccttttgcacttatgtcagtttagagtttgtgttcttgcagctggtaaagtcttaaattccactcccacatacaaatgatctccttgttcttgtactgggccctgcctgcctccagcattacattaaaacaacagcaagaagaataatagtcaaaacaacaatggtttaaaatctttagtttcttggggggggaaaatgccaaaagaaatttcagtcctgacacagagccaaaaatttggaaatccattttctccacctctctttccatacatctcatattcacactcacattcagctcttagagcagctggtccctgcacttgctccttttctctccacatgtcccccaaaactgacttttaaaacccagccccaattggcttttacattttgcctcctctcctgccttttcccagtcctatgggacactttgccagcctgcgcataattatcttagtagacaggagagggagaggctgtgaactccctctctctctctctctccctctttctctctctctctctctcacacacacacacacacacacagagtaatgtggttttgtttcccctgttgcacattattattattattttattttattttattattttgagacagagttttgctgtcattgcccaggctgcagtccagtggcatgatcttggctcactgcaacctccacctcccaggttcaagcgattctcctgcctcagcctcccgagtagctgggattacaggcacatgccaccacgcccagctaatttttgtatttttagtaaagatggggtttcaccacgttggccagtctggtcttgaacttctgaccttaggagatccacccacctcagcctcccaaactgttgggattacaggcgtaagccaccgtgcccagccacattattttttaaacattattcttggggacaacagaagactgtaaaatcccagctatggaggggagcatgacagtggagtcatactttcgaaagaaacactgaggtcttctaactatgagtcatatgccaagttcaagtcagtaaacacttagtgagtggctaaggcgtggcagataagaaccaggagaggggctgagttgtttagggcatatgaaattgtgtttgactgagccccattcagcaaaggtttgcttactcacagttcattgagcacctactatgtgccaggccctgagcgagtcattagagttgtatccaagaagtaagatattcagtgcacaaaaatgatgatattgtgattaattcatatcaaagagactgctatggtttgaatgtggccttcaaaattcatgtgctggaaactcaatccccaatgcgacagtgttgggaagtagggcctgatggaaggtgtgtaggtcgtgagggctctgccatcatcaatggattaatgagtccgtaaaaagggcttgtgagaatgggttctctctctctctctctctctcctcttctgtcatgtgaggacacggtgtcctccccttcagacgacaaaacattcagggtgccatcttggaagcagagagactgggtcataacctgaaggcatcttgaacttgaacttcccagcctccagagctgtgagaaataaatttctgttctttgtaaataactcactctgtggtattttgttacagcagcgcaaaatgggctaagtcagagacatacatggggattgggagcaaatcaaagacagtggttaagaaagcctccctgaggaagtggcatgtgagctgagactgaatcaagaataggggcctgttggaagactagcggaagataagcctgggaaggaaattcccaccacagggaccagtgtttgaaaaggccagggggcaagagaaagaagggaactggaagcctctgtggccggaacacagagaactagtggggaacttcaaaaggtggatggaggccacattgtgaaaaccttcaacagctgcataagagattttgagcctcaagtcatggaccagagacttttaacatgagccccataggcccttaggggttgggatgtggtttgttctaaacatagaaaagctcagctgtggtgccacagatgttgggtcctccaacagtgagggaaattggcttcgtccacccagtggtgtgctggagctggctcctacaggctcaggagccaattgtgcacatttcttctgttttgttttttttttgtttttgtttttgttttgagatggagtctttctctgccgcccaggctggagtgcagtagcgtgatcttggctcactgcaagctcctcctcctgggttcacgccattctcctgcctcagcctcccgagtagctgggactacaggcacccgccaccgcacccggctaatttttttgtatttttagtaaagatggggtttcaccatgttagctaggatggtcttgatctcctgacctcgtgatccgcccccctcagcctcccaaagtgctgggattacaggcatgagccactgtgcccggccacatttcttcttatctctgtgttcagtgacctcacatttgctagcttaaagtcagccacagtggggatattcacaccacgaaggttgggaaacacaagaaagcaggacttttacccctgtcccctaaacccccaaccagttgtgaaacatttatcagcaccactgcttcatacctaatattccaacccaaagaggaagctggctcttcagtgcccaccgttccactcatgagagttgagaggttagcgccatgatctttgcaaatcaggaagtgattaagactggggaggtttgttcttgtttgcccttaagcaagcaagaggctgggtagcagaagttttaaaaccacaagctttgaggacagacagactgagttccaaattgcagccctatcactataattagctgtgtgacctaagcaaggatgtaacctctctgagtttcatctgttgaaaggggatattaataatatccacctcatagggttgttgtgaagattaaatactgtatgtaaactgcagtgccactatataacaaagactcaataaagattcgtgcagtcagctgtttgggataaagagatatcaatagagatatattcattttattccagaatggatggattgtatttgagatacctgaaagaaattgaagcagtgtatttaggacctaagtagaagcaaggtcgtggtaactggctgagattttctgaccggcatctatagatgacattttttttaaggttttgaaagatccaacttggccaagctcatagtcacaaaatgtctcttgaaggatcaaggcatctgaacacacaattttctaactcgaagctatgcgtgggcggggaggtgggggaagaggaacaagagaacaaacatgtgacaaacaaattgtcaaaaaagagcaagtgccagtttcagatgcatagcacaggagcccatgggtggagcaggtggcaaatgaagatatttctgtacctgctgttgaaccgctccaagcacagtgggattccgggtctaaaagagttgcagttgctgggtggaaatgaaagtcaacatttcagggccgggtgcatggctcatgcctataatcccagcactttggaaggccgaggtgggcagatcacttgaggccaggagttcgagattagcctggccaacatggcgaaaccccgtctttactaaaaatacacaaattagctgggcatggtggcttacgcctgtagtcccagctacttggcaggctgcggcatgagaatcgcttgaaccagtaggtagaggttgcagtgaaccatgatcacgctactgcactccagcctgggtgacagagtgagactcttgtcaaaaaaaaagaaagcaagaaaataagaaagcaagaaagaaggaaagagagagaaaaaagaaggaaggaaggaaggaaggaaggaaggaaggaaggaaagaaagaaagaaagaaagaaagaaagaaagaaagaaagaaagaaagaaagaaagaaagaaagagaaaggaaggaaggaaggagaaaagaaagtcaacagtcaacatttcagagatcccaagataccaacactgaccgtgcctgctgctcttccatcctcctccaccctgcgcctttgaggtggaattgcgtcctctgtgagcagggctttgttaagagatcctaattaaggccaggcacagtggctcatgcctgtaatcccagcactttgggaggctgaggtcacctgaggtcaggagttcaagaccagcctgcccaacatggtgaaaccccatctctacaaaaattagctgagcatgatggcaggtgcctgtaatcccaactacttgggaggctgaagtgagaaaatagcttgaacccaggaggcggggttgcagtgagccaagatcacactattgcattccagcctgggcgacagagcttttgtctaaaaaaaaaaaaagaaaaaaaatcctgattaagcagaagccttgatgctagtcccagaagcatcctgaaatttccaaaagaaatttcccccgcggttaaactcagagcaacttttggacccaccaagctctgtgaaaatcattttctcttccaaaaactgatgggaccaaagctgatcccagtttcaaataattatcaaaaaattggaaacgaaatatgatcagaaaagaagaaagttgaaaaagaaaatcctcatcacccaaagacaacaaccattaatattttggtaattattattccaaatatctttctatgcatacagacagactgacacacacacacacacacacacacacacacacacacacactttttttttttttttgaaactgagtttcactctgtcgcccaggctggagtgcagtggcgcgatctcggctcactgcaacctccgcctcctgggttcaagcgattctcctgcctcagcctccctgatagctgggattacaggtgaatgccaccacgcccggctgattttctgtatttttagtagagacggggtttcaccatgttggccaggcttgtctccaactcctgacctcaggcgatccacccgcctcaccctcccaaagtgctgggattacaggcgtgagccaccgcgcccggctacacacacacttttttaatgggcctatgttttagcactcgcttttctgtttctcagtgtgttgcaaacacctcggtgtcgatacacaccattcggcaacgtcctcctaaagggccgcataatattgcgcgtcgtggcgtgtgccttactgggaagctactgctgtccaggtgaacaccacagccttcggggtcagaaagacagctttccccagaacaagcacctgaagctctggggcctgccgctccccgggagagaagtacgtggagaagggcagcacggatccgccgggatccccgggggcattaaagggaatcgcgtgtgtaaggcgcggagctcagcatccggctcagaaacgcgctcggatcccgccaatggcattgaggccgcgtagccaaaccggccttgaactctccctaatcctgccaaaatggcccgtcctggagcactggactggccgtgggttattgatcatcagccggtttcttcccctcccctgcccttcccccgtgcacggatttactgatttttttttccgggaattgagtaaaacaaaactaagtgcagatgaagcagaggtacgggcgagtttcgagcgcggggaccggcgcgctcccccccccccctccccccgcggcggggctgtccccagggaccttctcagtgaatcctaggcggcagggacgggcccgcggctctgcgggccattggctgccgactgcgtcacctgcccgcggtgggctaggagacgggaggcgggaggcgggaggcggggacctgggtccgggcggggacgccgcggcaggaaggccatggcggggcccgagcgctggggccccctgctcctgtgcctgctgcaggccgctccaggtaagggcgcggggccgcgggagggagggggaagagggctccccgggccgggccgcgcctaccctcggacccggagctcctgggacaggcacggggtccgcagccacccgagccgggtgcgaatcggccctgcctacgcgcccccagtttgcttcttcccaggactgaacagaaccgggtctttgatattcctctcccgcaggaaacgaatccagtttcctaatgcttccagcttcaggagaactggagaaaaaagacagcggcagtttgatactgcatattttttaataaagtgctttttaatgtttcctaaagaaagcactgatccctgcgtgaaaaccacacttgaccctaaagtgtggacagcagggaaagtgggaccgattgatgtcccttcccgttcctgccaggcctctggtgggacggagctctggtcgcctgtgccctgctttctaacaagacggctttcttttggtggtggttgttgttttgttgttgttttgttgttgttgttgttgttgttgttttcccacctctactgatgagtaaggtgtcaggtacaaaattcctcgccgtaggacccaaccaccaaacctcaccgcccacgactccaaccgaagcagggaagagaaggtccagaaatcgcccccaggatattttcctagtcttggactcacagtttaaagagctgtaaaggtccctgggcataatccaatcatcataaaagcctatatttattcagcaacttctttgtgccaggcaccgcattattctggaagcctcacgacccagccatcctaggaggtagatattatttttacttttccgatgggaaaactgaggctcagagcaattcagggaattcctcaagaaggacggcagaggtgaggcacacagaagagagaagaggggctaaagcaagcctggctagcttttgcctccagggtaggcacgtgggacaggctgtccatccactgggtcactaggccagccagggatgctccagcccccagtgcccacagcagcgttctctgtggctgatgagggaccgtgtacctgtgtgtggagggagggtggggtcttctgttcccctttcactgtcaagcccagaccttcttgtactttcacctgataagtatttaatatacacaacactaactatggtgtgatgatttaggagtaagtacagccagatctaagttcaaatactggctcccacacaaactgactgtgtagcctcaggcaagttagttagcatctgtctctgagcctagcgccctttccatggaagcagaatgaatgacacctaccccatagggtggtctgtcccaagggtgattgaggttttacatgtaaagagccaaactagtgcctggcatcctttgaaggcttcatagaggaaagttgctctagctgctgtttttctcatgtgacctagctcgaatctggggactgtcctgcccataggataccttacaagtggcttgcagacagcctggtctcctgctggtcacccgttaggaagtccagaagctgggagtagtaatagcactagcctcgtggtgatacagtcccagctagaggacacaggatgaggtggaagcaggcacccacttttgggtctaaaaggtgatgggtaggcagccgaggctggggacagccatccacagaactggaccctccctccctgatgccattttgcaacccgtatggatttccatcatggcacatgggacacttcaggaccctgaattctccatgggaccatgagctcctatagggcaggaatgaagttgtgttcttctttgaaacccctggcacaccgtggtcaacagatcttgtttgactcgtagtggtcaatagatggaatagttggaatcataaagctcaatagaccccatgagaacctagaagacaaagtacagtcaagagctcggactttggagttggctaggcctggactgaatctgattctacaacttaatagctgagagggccttggttttcccatctgtaaagattataattattataatgaatacctacctcctagggatgtaatgaggattaaaagagaaagtgcaggtaaactgtttaacacagaacctggctcatagaacacaatacacattagctgctattattattattattattttatttatttattttgagacagagtctcactctgtcacccaggctggagtgcagtggcgcaatctcggctcactgcaacctccacctatcgggttcaagcaattctcgtgtctcagcctcccaagtagctgagatgacaggcgtgtgccaccatgcccaactaatttttgtatttttagaagagacgtggtttcaccatgttggccaggctggtctcaaactcctgacctcaggtgatttgcctacctctgcctcccaaaatgctgggatcacaggggtgagttaccatgcccggccttagctgctattattatcatcatcgttatcatcatcatcatcacctcgtagatatgtcaaggaagattccctggaggaagtgacatttgaatcaagtatttcaaagactagatggtgaataccaggcagtcaaagacacctgggtttaaaaacatccagaagaatgcagtggcttggcaacatcgagcaggaagattgcctgatgagcctgtagggtagctgttggggagagagcagcaagacggcctggccaggccaggccaggccacgtcaggcagggcctcacaaacctcaataacaaatgtggactttattctgaggccaaggaaagggcatgaaactggggagtggtgtaatcagatgcgtatttcagaagatgaagattaacagtgagaaggaaaatgtgccacagaggggaatagaggtcagttaaagggagtcagggaaagtgtcctcgagacagtgacatcaaaggaatgtgaaaacagcaaaggagtgagccaggtggatatccaggggcagaactgttaaggcagagggaacagcatgagggaacagcgtgtgcaaaggcctggagttgggagtgtggctggggtgctccaggaagggcaaaaagtcctgtgtggatggagatatgggagcaagggaggagtggtgggtcagattgggtagggccttggtggtgattgtaaagactctggagtttagaccaggcacagtggctcaggcctgtaatcccagcactttgagaggccaaggtgggcggatcacctgaggtcaggagttcgagaccagcctagccaacatggtgaaacctcgtctcaactaaaaatacccaaattaaccaggtgtggtggcacaaacctgtaatcccagctactctggaggctgaggcaggagaatcgcttgaacccggaaggtggaggttgcagtgagctgagattgtgccactgtactccagcctgggtggcagcataagactctgcctcaaaataaaataaaaataataaagacttttgagtttccctggagtgagaggaaagccttagagggctttagcaggagatgaacatgatctgattttcatttttaatccttcctgctatgtggagaatggactgaaggcaaggtgttttgtatatttgtctgtttcgtagagacagggtcttgctctgttggccagactgaagtgcagtggcacaatcacggcagccttgaactcctgggctcaggcgaaactcccacctcagcctccttactctcaccattgtgccctgctaattttttaaaaaatttattttgtagagatgtggtctcactatgttgcctaggcaagtcttaaattcctggtctcaaatgattctcctgcctcgatgtcccaaagtgctgggattacaggtgtcagctgccatgcccgacctgtatttttttttttaatggggaaaaagccttttaatagtatgaggtgttttctggtgtttctaccataaagctcttctgtaaatcaaaatgagaatgtaattattgatagagcaatgaccttagactacagtgcagacttttcatcttacatttgggctcatgaattttagtataactgattatgacagtgttttttacatagttatgatctagagcagaactgaaaacaaaataacacatactctacatcaatatattcgttcagtaatatctgggcttggatgaacctgcagaagtaggtaaagctgtcagatattttcttaaaccaacagaaaagaaatgtatatgacagatgttgtgtttacttacttatttatttatttatttatttatttgagatggagtctcactgtgtcaccaggctggagtacagtggtgtgatctctgctcactgcaacctccacctcccggattcaagcgattctcctgcctcagcctcctgagtagctgggattacaggcgtgcaccaccacgcctggctaatttttgtgtttttagtagagacagggtttcaccatgttggtcaggctggtctcgaactcctgacctcgggatctgcccacatcagcctcccaaagtactgggattacaggcatgaaccaccacgcccagcctgtatttatttttttaccactatggagtccaatatgaaattctcacaactatgcatatacattattaacatgtaagcacacctaggtataaatatgcacatagtccattaattacatcaggggaattaaaaacatactttcaagttaaaatgaattttcaggaaaaaaactgcattcacaaatctgaaatgtgaatacaaaaatgaaattgtgaaataaataatgaatataggtgtcacctaaacttccatagtaacatgcctccaaatgtggatttagtgatcatccaccttgggacaagggcttttgagagcctccagctaaattagggttccagtagcagagtggctggcaagcctgccctaatgaataatgccagcgagctgggcgtgggtacttacagtgtgcccttcatggaatacttttttttttttttttggaatggagtctcgccctgttgcccaggctggaatgcagtggcacaatctcagctcactgcaacctcgtcctcctgggttcaagcaattctcgtgcctcagcctcccaggtagctgagactacagccctgtgccatcatgttctgctaatttttgcatttttagtagagacgaggtttcaccaagttggccaagactggtcttgaattcctgacctcaggtgatctgcccaccttgacctcccaaagtgctgggattacaggcttgagccactgcgcccggcccatgaaatacttcttacctggcggacagcctaatagcctagctgtctaacccatggctgggggtccttcacacttgtttatactggcagacgtccctgtgactcttgtctgatccatgtccaagtttatgcctgtctgaccattgctctggcgctgggagccagactgtgttcccagcaacccagggaaaaccaggcctgggctgggcctgggttcctgagatggaaggtgcaaattcagtacaccacctcaatgcaaaacaagttcaaaggcttattacttacagatcctgagcagggaaggtgcaatgagtagggagggtcatcctccatcctgggctacatgaagcgggaatgaagagtcaggcaaaaagaaagtgagagcttgtggcaatgagaagtatattatgtaagggactagggtgtgggtcaggttaagtttgagggcaaatgcttgaatgatccctttaaaggaatgggtgggaagtggggagcccagtttgccgggagggagagatgcctcgaagttcttatctctggccactggcttggaccatctgagtgtggcatctacttctaatgcctaggcagcaacctttgctgtgtcatctcccttacacaaggttggaagcaaggagaccggtcaggaagcctttggtgtaacccatgttattgtaatattcattcatttactcaacagatgtttattgtgcacctactatgtgctgaggccatggcaggcaggctctggggatgtggctgagaacaggacagagcccctggtccttgatatcctcaaggatgctccctcctggaggccattaggttcctgttccatggtgttctgctggaaccctccggtcccagagtgtgcaggagcctcccctcctggcaaagggtcttctctcatggcacaagggctgcagtacagccagtcagtggctcctggttcctcaaactcagtgagcacttgcctgcccttcgtgctgcccctcagcttgggatggcctgagtcaagaccagccaggagctccaggcttcatgacccctttctttcccccagggaggccccgtctggcccctccccagaatgtgacgctgctctcccagaacttcagcgtgtacctgacatggctcccagggcttggcaacccccaggatgtgacctattttgtggcctatcagaggtagaggggactctctcggctggtggatgggaagactgagggggtgggtgggggctggaggggcttctctgggacagctgcacccagtgtgggcagcactggctagctctctgggccctacgggagatggcatgtggccggcatttggagaggggcttttgataaaggtctggaggtggggaagatgttgaatgaagagcagtgtacaggtgaccagtctgccggggcgggggtaagtctttgaggaaagttggtgtggggcatggatgtagctgtgggggccagaggatgaaattctcaagtggctggatgaggtgcttggagctgtcccagctgatcagtgaggcaactaggtacacggcagaggagctgttacctgggcaattaggcatccctcaatgatcacactttttttctcttttttttttttttttgagacagagtcttggtctgtcacccaagctggagtgcagtggcttgatctcggctcactgcaacctccacctcctgggttcaagtgattctcctgcctcagcctccagagtagctgggattacaggcatatgccaccacatctggctaatttttgtatttttaatacagacgaggtttctccatgttgcccacgctggtctcgaactcctgagctcaggtgatccacccacctcagcctcccaaagtgttgggattacaggcgtaagccaccgcgcttggccaaatggtcacacttttcccgatgggatcattctcaatttggaagcccaggcagccacagcgaatccagagaaatctgacaatggaagcagatccaccatcttcgaacatagatgggaatcgttcagagttctttagcaggacagtgagatgatagaagcagaagctcgggaggattcacctggagttggtgaggaggggaaagcaggaagaggaggggaccaccgtgtcctcaggacccgtcctgtgccaggccaagtgctaagggccctacgtgaatatttcacttccttctcccaatgtgaccaggcaggctctgtgttttccccattctagaggtgaggggattgagctcagagggtgctgtgtcttgtctgaggaaggacgtcatggagccagaaggggaactcgggtccgactccaacatttgtgcccttcctgttgcatcacgtcatccttccatgtgtggaatccacatgtgagtgatgggagcctggcttgagcagggacagactgcaagagagctttcaaaagcaagagcgttatcaggtgccagaaaacacctaatatttactgtgtggctggcactgtgtcaacacatgtaatgaacttaatctcacagcagctctctgaggacaagttcagtacgcctctttacagaggaggagactgaagcaccaagggtgcatgttgctcaaagtcacacagctgggcgtagtatggctggaataaatttattaaggagttgaaagtctatcctctaggaccaagcatggtggcttacatctgtaatcccagcactttgggaggccgaggtgggtggggagattgcttgagtccaagagttcgagaccagcctgggtaacatggtgaaaccctgtctctacaaaaaaaaaaaatacaaaaaattagtgaagtgtagtagcatgtgcctgtgttcccagctacttgggaggctgaggtggggaggatcacttgagcccaggagatggaggttgcagtgagctgagatcacaccactgcactccaacctgaacaacagagcaagatcctaaaaagaaagaaaatctatcctctgaacttctatgatatttttcatgtcttttatacattagaatggtgatattctaattatataatttttttcatttgttagttggaattattttataaagagatgtatcctctcatctggtatttgatatccagtcatactattcaaataggcaagagaggataaatgcttaatttttttcctttatcaattttcaagataatgaattggttccttatcatctcccaaaggtgattgctagtttattattatcattatgaactcaggcatttaaacacatttggtggtttcagtctattgcgacgtactctgctcattgaagcttgaattgcctcatctctgtccagtgggagtctcatcaagtttgctcctgagtccttttaacttgaccctagtggtcaagttaaatctttccagatttaacagatacctttccagctgtccattacgacaagatgttccaggtccctctggtacaattcctgacctaaaacctgcagtcagccatttctccatttagtaagaaatggttataaagactataatctgcatgctagctatgctgatcactacttagctattgcttttggtgttttcagtgaacagagtgatgtgtgtataccacatagacacacacatgtacatactttttttttttagacagagcttcactctgtcacccaggccagagtgcagtggcatgatctcggctcactgcaacctccacctcctgggttcaagagattatcctgcctcagcctactaagtagttgggattacaggcgcccaccaccatacccggctaatttttgtatttttagtagagacggggtttcaccatgttggccaggctggtgtcgaactcctgacctcaagtgatctgcccccctcggcctcccaaaatgctgggattacaggcatgagccatcgcacccagcctacatgtacataatttttaagataaaatgcctaatgagttatacgggtgcttcccatctaaatttagttccttaggatttttacctgacttctatggtacatctatattttctttctttcacactgagaatcctgtttctcaaggacaggggacatgatagaactagaatgacccataattactcattttctttatcccaaaacatacatacttgcctcttaatagtttcttgctcttttcgcccaaagggtttgtgatggtcaatattaggtgtcaacttaattgggttgaaggatgcctagatggctgttaaagttttgtttctgggggtgtctgtgagggtgttgccagaggagactgacatttgagtcagtggactgggaatggaagactcgtcctcactcagtgtgggtgggcacaacccaactggctgccaggctggctggaaagcaggtggcagatggtgggatagcttcgcttgctgggtcttccagcttccttctttctcccgtgcgggatgcttccttctgctcctcctgcccttgaacatcacactccgggttttttggcctttagactcttggacttaagttagtggtttgctgggggctctcggatctttggtcacagactgaaggctgcactttcagcttccctggttttgagggtttcagattcggactgagtcactatggcttctttctttcccaccttgctgacggcctatcgtgggacttcgccttgtgatcgtgtgagccaattctccttaataaactccctttcatatatacgtataacctattagttctgttcctctggagaaccctgactaataaagggttgttgctttttctttaaaatctagtaattttatttgactgtgtgttggtattgctcattcattctgagttgatatttttaggcactcaatattctcacttaatacatggttccaaggcatttttattttaggaaggttttcttaaattatagttttagtatttgttctattctcttgttttgattttcttctttagggactcatatcacttgtatgttggatcttctttttctgtgttcagtatttgtcttttgggcacagagactcacacctataattccaagactttgtgaggcataggtaggaggatcgcttgagcccaggagtttgagaccagcctgggcaacatggtgaggccctgtctcaaattaaagaaaaaggagagaatacttgtctttttctttcaaatgccttttatctgtctgtctatctactattctgctctctaaatgaaataggtttcactcttgagtttttaaaaaactgtgtgcttccatgtgtgagattattcaacatcttatttgtaatctttctcttggttacatttatttttcctgaaactctagtctgcttttagctgacatgtttgtagctaagagcgcacatttcttatcatagcttgccgtgctgaattaattccaattttcttttaaaaccaacattattgagttaaaatgtatatagaataaactgttcccattttaaagtatacaatttgatgagttttgacaaaagtgggcacccacgtacccaccaccacaatcaagatgtaagacgttctctatcaccccagaaagttccctcatccactttgcattcaggcctccagatctaggcaaccacagatctgctttctgacactgtggattaaactttgcctgttccagaatttcatataaatggatgtgtatagtatgtaccctttcgtgtctggctcctttccctcagcataatgtttctgaaattcacccacattgttacatgtatcagtagttaattcctttttattgctgagtagtaatgccattgtatgactatgtatgacatttgttaatccattttcccgtcagtggatatttgggttgcttccagttctgggcaggtattcatttgctagggctgccatatgcttgccctctggcctcccaaaatttgtgtccttttcatatgcaaaatacattcaccccctcccaacagccccaaaactctcttttttttttttttttgaaacagagttttgctcttgttgcccaagctggagtgcaatggtgtgatctcggctcactgcaacctctgcctcccgggttcaagagattctcctgcctcagcctcctgagtagctgggattacaggcatgcgccaccacgcctggctaattttttatatttttagtagaaatggggtttcaccgtgttagccaggctggtcttgaactcctgacctcaggtgatccgcctgccttggcctcccaaagggctgggattacaggcatgagctactgcacctggctagccccaaaactcttaacccatttcagcatctactctaagtccaaagtctcatctaaatcaggtatgggtgtgactggaggtgttactcatcctgaggccaaattcctctccacttatgaacctgtgaaaccagacaggttatgtgctttgaaaataaagtgatgggacatgcatgggatagactttcccattccaaaagagaaaaataggaaagaaggaaagagtgacaggtcccaagcaagtctaaaacctcgcagggcaaattccattagattttaagtttcaagaatagccctctttggctcagtgctctgccctttgggcccactggggcggcagccctatcccctttgccctgggtggtgaccctaccctcgagtcactggttagcagcagcctagcctgctgaaactaaggaggggacagtgttgcctccaggtctttggtggcagtgacaaccctgctgatctctgaatcatcttccaggaaatttttccctatacttgaaggatattgcgtgttcacagccaaatagctccagctcttgtccctttctttagaatcccagaagtccaacagccttccttcattctgtcccatctctgtcccctttagtcaaagctggaagtgcctctgctggtataatcccatcagtatgtctaatttctgcttaaatggctgattaagtctatgagttgcacctctgatctctttatcaaaaggttgttctagccacaaccttagtgtcctccccagaacatgctttctcatttttttttttgcaatgtggataggctgaaaattttccaaagcttcaagttctagttccttttggcttaccaattcttttcatatatctcttctctcacattttactataagcagtaagaagaaaccaggttgtaccttcagcactttgcttagaaatctcttctgctaagcatccaagtttatgtcttttaaattatctttttgttatttattttatattatcatttttgagatggctagccaatgatcttttaacttctaatttctgcaaaacactagaagacaattcaaccagttctttgccactttataacaaggatcacctttcctccagtttccaataacacattcctcttttccacctgagacctcaccagaatcacctttaatgtctatattcctaccaatagtctttttaaggcaatataggctttctctaacatgcacttcaaacttcaagattctacccattatgcaattccaaagccacttccacatttttaggtattgattacctcagcacctcatttctggtgcccaaatctgcactggtttgctagggctgccataacaaagtacgacagtctgggtaaacaacagaattttattttctcaaaattctggaggttggaagtccaaggtcaaggcgttgctaggtttagtttctcctgaagcctctctccttggctagcagatggctgccttcttgctgtgtcctcacgtggctttttctctgtgtgtgttcactctggtatctcttcctcttcttacaagtacaccagtcctactggattagggccccagccttattacttcatttaaccataattacctctttaaagctcttatctcaaaacacaataccactggggatgaggtcttcaacatatgaattttgggggaactcaattcgtccataatagggctattatgaattaagctgctgtgaacattcatgtacaagtctttgtgtggatatgttttcatttctcttagataaagatctaggagtatcagcctgggcaacatagtgagaccccatctttacaaaaaattttcaaaattagccaggcatggtggcgtacacctgtagccctgccatctcaggaggctgaggtgggaggatcccttgagcccaggggttttagactgcagtgaactatgattgcaccactgcaccccagcctgggtgacagagtgagactctgtctctaaaaaaaagagagagaggggaggaaggaaagaagaaagagagggagggaaggagggagggagggagggagaagaaaaatggatctagggttaagatttaggagattaggtaatgaatgtgtactattacagggaactgtcgagctgtttccaaagtgactgtaccattgttcattgccaccaacaatacatgagagttctagttactccatgtgcttgttacacttagtattatcagtctttttcattttaaccattctagtgagtatgtagtagtattttattatggctttaatttacaactccctaatgatgaatgatgttgaacatcttttcatgtgcttattggccattcatatatcttttgtgaagtgactattcaaatatttttccactttttattaggtcatttattttcttattattgagttatctatgaatacaaatcctttatcagtgtatgtattgtgatttttttccccagtggctggccttttcattttcgttaggcttttttggtgggtttttttttttttttttggaagagaaaaatattttaatttgataaaatccagtatatcaggtgttatagactgaattatactctaccccacaaattcatatgttgaagccctaacctctaagtgactatttggagatgagcctttaaggaggtaattaaagtaaaatgagatcataagggtgggccctaatctaataggactggtgtctttataagaagaggaagacaccaagagcgcatgcacacagaagaacggccttgtgaggacacagcaagatgacggccatctgcaagccaaggagagaggcctcagtagaaaccaaacctgctgatgccttgatcttggacttccagcctccagatttctgttgctgaagccaccctgcctgtggtgtcttaccatggcagccctcacagactaatatatcagatttttttccttcaacagttaacgcttttggtgtcctaagcaatattcgcctgacccagggtcatgaagatttttcttctatgctttcttctggaagttctataattttagcttttacatatttttttaactttccttcttcttgccttctgtttcttttaaggcatcatctattgtgttaatttgttcttgtattccttctgatttattcttcacttctgaaatgaattttgctttttaaaaatatatataattcttttctgtgtctgagtttttctaattaggttttatgtggttttttcttgtcctgcatcactttttactgtcttttgcccattttgaagtatcaggttccagttttgatctgttcatggatatgtttttgtgacatgtttcttctggcttcttatcatttattgcttagcttattaatttctattctttcttattttctattataagtatttaaagctatatgttttcctctaagtattacttagctgtcttatacgttttcatttgtgttatttggtgatcattcactttcagctatttattaatttccattataattctttcatctatgggttgttttaaaaaatatttttaaggccaggtgtggtgactcacatctgtaatcacagcacttagggaggctgaggtgggaggattgcttgaggccagaagtttgagaccggcctaggcaacaaagtgagaccccctctctacagaatatttttttaaaattagctgggccaggcgtggtggctcatcccagcacctgtaataccagcactttgggaggccaaggcagatggatcacctgaggtcaggagttcgagaccagcctgggcaacatggtaaaaccccatctctactaaaatataaaaattagccaggtgtggtgataggtgcctgtaatcccagctacttgggaggctgaggcaggagaattctttgaacccaggaggaggagtttgcagtgagccgagattgcaccactgcactccagcctggatgacagagcgagactctgtctcaaaaaaaaaaagaaaagaaaattagctgggtgtagtggcaggtacctgtggtcccagtgactcagagactgaggcaggaggatcacctgagcccaggagtagaggctgcagtgagctatgtttgtgccactgcactccagcctgtgcaacagagcaagacgctgtctcaaaaaatatatatttttttaaattttcaaacttcctttagttctctttttgttattaacttttaactgaatgttttgcaatcagaagaaatactttatgagatacctattctttaaaatttcttaagaattgctttgtgttaatattttgttaatagttcacatgtggttcaaccaatttgtttagttagttctgtatatgttcattagaccaacttgataactgtgttgttctttatttatttatgtatttatttttctttgtctattcatcaattgctgggtgagatgtattaaaatttcttgttgtaagtgtggctgttcactttctacctgtagtttgtctgtttgctttatagagggtgaagttgtttagtaggcacacataagttagaatttttctgtcttcctggtgaatggaatcatttatcattatctaatgttcttttcatctttagtattgctttggacttggaagtctgtattttgtctcctgttaatataactacactggttcctttggtgtgaatatttgcatagtataacattttccatgaagaaacaaaacagaggaattggttctttctcaaaatctgatctttgtgtcagcccccatctcagccttctccattcatccttggtcactccccaaacccaggagcaatccttgattctccttttccccacattctacatccaatccgttagcaagttctattagttctattattacctccaaaatagatattgaatccagccctttctcactgtctccaccatcatcctgtctcacatccctaccatggcctccttgctggttgaccagagtgatcttgtaaaaacatgttaggccaggcacggtggctcctgcctgtaatcccaacactttgggaggccaagcgggtgggtcacctgaggtcaggagttggagaccagcctggccgacatggtgaaaccctgtctctactaaaaatacaaaattagccaggtgtggttacgctggcctgtaatcccatctactcgggaggctgaggcaggagaatcacttgaacccaggaggcggaggttgcagtgagccaagatcatgccactgcaccccagcctgggcaacagaacaagactccatctcaaaaaataaaaattaaaataaaatgttaggctccctgggtctctggcttagtccatttgtactgctttaacaaaataccttagaatggtgtaattctaataattgctattaataaataatagcaattaataaataatagcaatttccttctcacagttctagaggctgggaagttcagggtcaaggtggcacctgactccgttctggtaagggcggctctctgcttccaagatggtgccttctcgctgcgtcttcgcatagcggaagggcaaacactgtgtcctcacgtggcagaagagatagaagggccaggcagctctctgaagtatccaggttggagtcatggacctgcatgttcccctctgacatccacagagtacctatcatggtccttggcatgcagcaggtggcccataaacgcctgaatgaacaaacatatagtaatggtcgctagtactaggaatagcagccaccgcaacagtcctgtgagggaggcattacagatgaggaaactgaggtttaggggcaaggacctgcccatggtcccaaagctagggagggacagggctgggattcccactcccatccatctggctccagaacctgagctcctgaccaggctgttcttatcctgtctcagccagtggctgcctgtctggacggatggacctaaagtcagtccagccaaacagagggaagcatgatcaactgttctctaagttccctgacccggagaggctgagtccatggcccaagctctcctctctcctcccccagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaaggtaggtctgtgggtaagggactgagtggaaggctgtccatcccatcggggagctgtgctcagtgctcagtggttctgttctcctgaccatctgtctcccacttccccaaagcagagggcagctccctgggccaggccctttgagatggggtgtgggaccagcaacagcgagggaccatgtctggcagcctgtcagggagttaggggagctccagccagcaccagcaatctcacgtgcaccctctgctaacaatgttcattattttcagttgagcaccattttggtcatggactacacaaggcactttatatgcttattcctatttttttatgttcagcttctctccttaaaaacaatgtttaaaaccaattctgggccaggcgtggtggctcacgcctgtaatcccagcactttgggaggccaaggcaggtggatcacctgaggtcaggagtttgagaccaccctggccaacatggcaaaaccccgtctttactaaaaatacaaaaattagccaggcttggtggcaggcacctgtaatcccagctactcgggaggctgaggcaggagaatcgcttgaacccaggaggcggaggttgcagtgagccaagatcacgcccctgcactccagcctgggcgacagagcgtctcaaaagaaaaaaattaataaacaaagaaaaaaaaacaaattctgtttgcaaaagtattttctatacactgtagaaatttgtggggtgtgggggggtaaagatgatagaaaaaaaaatgtcccatgcttactggcagaaatcatgtattgacattgggtgaggagggcactttttttttttcagtctatttttaatcttcacagcaaacttgtgaggttcatttccatcaacctgagactcacagaagctaagaaacttgataccgctagtaaccagtggacttgataccgctagtaaccggtggacatagatgtgaactggatctttctgacctcgggcagggccgggtaacaaggggaggataaatgcccagacagtgtcctcagagagctgagagctgtaacttgctgcccgggcttctcacagtgttcaaggacaaaataaggctttaagagagaagagggacagactgattgcagggcagcaggaagagatggtagagaaggaagaagagatgattcgtgtggaaagaagctggctcggtggatggataaaagaagggaaggacagatgggtaagaagaaagggaggatggaggggatggaggaggaagcaatggaaaaatgggaaggaaggaggttggatggaaggatagatgcctattaggaaggaaatatgtgtggatagagagatggaggataggaagtatgttagtcaaggttctccagagaaactgaaccaataggatatatacagatacactaagaggaggccagccgggcgcggtggctcaagcttgtaatcccagcactttaggaggccgaggcgggcggatcacgaggtcaggagatcaagaccatcctggctaacacagtgaaaccccgactctactaaaaatacaaaaaaaaattagttgggcgtgatgatgtgcgcctgtagtcccagctgctggggaggctaaggcaggaggatggcgtgaacccaggaggcagagcttgcagtgagctgagatcgtgccactgcacttcagcctgggtgacagagcaagactccgtctcaaaataaataaataaataaataaaaagaggccagccatggtggctcacacctgtaatctgagcactttgggaggccgaggcggatggatcatttgagatcaggagttcaagaccagcctggccaacatggtgaaaccctgtctctactaaaaatacaaaagttacccgtgtgtggtggcacacacctgtagtcccagctactcaggaggctgaggcaggagaattgcttgaacttgggaagcagaggttgcagtgagctgagatcacgacactgcactccagcctgggtgacagagcaagactttgtctcaaaaaaaaaaaatttataataagaggagatttattatgggaattggctcatgcaatcacagacacaaaaatgtcccccagcatgcagtcatgggctggacaaccaggaaagcttgtggtgtgattctgtctgagtctgaaggcccaaggccaggggagcagtggtgtaacccccagtccgaggccacaggcccgacaatcagaggggccactgatataagtcccagagtccaaatgccggagaacaggaagctccaacgtccaaggacaggagaagttgatgtgccagctcaggaagagagaatgtgaatgtgccattcctcctccattttttgttctctttgggccgtcagtggattggatgatgcctgcccacactggtgaggacagatcatcaccaaatctgccgattaaaatgttaatctcttctggaaaaatcctcacagatgggcccagaaataatgttttactgtctacctgggtatcccttagtgcagctaaattgacacataaacttaaccatcacaggccaggcactgtggctcacacctgtaatcccatcactttgggaggccaaggtgggaagatcctttgaggatgaggtaggcagatcacttgagcctaggagttcaagaccagcctaggcaacatagggagacctcgtctctacaaaaaaaaaaaaaatttaaattcgctgggtacggtggtgggcacctgtggtcccagctatctgggaggccaaggtaggaggatgacttgagcccaggaggtcaaggctgcagtgagccatgattgttccattgaattccagcctcggtgacagagcaacaccctgtcttaaagaaagaaaaaatttaaccatcacagaaggcagaagaaaaggcagatgggtggatgagatgggtgggtagatagtatagaagaaaagcgggacatccaggcagggaaggaagggctggagcgaaggagaagcaaggaaggaaggaaggagagacaagaaggaaggatgtgtagaaaggtggaagagaaaagaagaatggatgtatgggaagaatggatgagtaggttagaaggctcactggctagataaaaggtgagaagtataaatgaataataagaaaggaggcataggaagaaaaaaatattggttagaaaggatgattgagaagaaagggtggttgggaaggaaggaaggaaggatggatggatggatggatggatgggaaggaaaggaaggataagaaggcagacaggaaggctctctggctagaagaatggcagacaaaccacaataattgctgaatgggtaggaataagacattagaagaataaagggaaagacacaaagatatttaaaatgttttcattaattttttgcctcctccctgaatttctcctgattcttcagccccacatcccaagccagggtgatccttcctgcctttacactccctccacactttttctgctctcatatgtggccgtggtcactttcttttggtagtttgcatatttcatttaccccaaactttcagctcctgaaggtcaggatacaaggaggcctcatctccgcattcccctcagctcccttcctgaagcttgatacctagtcagtacccagtggatgtttcctaaacatgtaagtaatgacatcatgaagaagccacatgtttaccttgaccacaaacacagggcaaaggtgactagtgtggtcagagatccctgctggctgggaatcagggaaggctgcatggaagaagtggcattttagttagaacttgaaaggtggtgtatttagttttctctggctgccatattccttgtcacattgccctctccatcttcaagccactgggcaaggctagaaggccctcaacagactatcggtaggaatgtggaagttgaagactcagagtgcagaaagaaacaagtagcattttagagaaaagctaaatcccctccaagaatacctcaatcatcgtgaagagcctgttagtagacgcactaacactcaaggcactgcttcacaaggtaaggaacgtgtaattgaaaacttgagaaaggaagaaacttgttctgtactggcagaaagcttagcagaattgtgtcctgcagtcatatgggacacagagcttgtaaatgatgaatttgaatgcttatccgagaaggtttccaaataaaatgtggaaggcacggcctggtttcttcctgcctcttatagtaaaatgcaagaggagagagagaaaatgagggaagaacttaaacagaaaggaaccaggacttgatgatttgggaggttctcaacctatgcaaaaaacaataaaattaagagattgtagctgggcacagtggctcatgcctgtaatcccagcactttgagagtccgaggcgagcagatcacctgaggtcaggagtttgagaccagcctggccaatgtggggaaactccgtctctactaaaaatacaaaaattagctgggtgtggtggcgggcacctgtaatcccagctactcaggaggctgaggtgggaggatcacttgaacccaagaggcggaggttgcagtgagccaagatcatgccactgcactccagcctgggtgggtgacagagcaagactccatctcaaaaaaaaaaaaaaaaagagattgctcccaaaagtgtgacatagagaaacagccaagtatgtgattataccaaacttcaggaagataaaagatcaaagtactcagtcgctcaaaaggctctttgaagagattaagattataactcacagtccccttcaatcaaaccaggggacttctaggaagctgaacagcattgtccctcagccatatcagctggagccaaaagtagagaagggcttatctgaaaaaaggatctgtggacctggcttttatctaataatgcagtggattcccccatgacatccataggagacccgtaaagttcctgagacgtttacatccacagaaacactgttagcttggattaaatggaacacagagagtatgaaatcaaagaaggctgttggactctccagtttctactgttgagatgcagactggtaaaactacttagctgcaaacacctgctacctttagtgaaaaggaaggatatctcagacggtgaaaccagaagctcaaagggcagtgctaagagcgaaagagaattcttcccaggccttgaaacctaatggagttttcttggctggattttcaaactgcattggaccatgacctgattgtccctttcatgtccccatgcttgagccagattgtctgcaactgttatcctgtgcctgtcccacattttatgttgggagcagaaaactttagttttgctggcccacagatagagagaaactgtaccccgagagttgtactgactggactatgcccagagtctatttgactctgacttagatactgttgatttgggaatttgagttgatgctgtaatgagatgagactttgggggacattgggatggagtgaatggattttgcatttgaaagagatgtgggttgggtaatcctagcccacacctgtaatcccagcactttgggaggccgaggcaggcagatcacctgaggtcggcagttcgagaccagcctgaccaccatggagaaaccccatctctactaaaaatacaaaattagccaagcatggtagcacatgcctataatcccagctactcgggaggctgaggcagtagaatcgcttgaacccgggaggcagaggttgcggtgagccgagatcacgccattgcactccagcctgggcaacaagagtgaaactccatctaaaaaaaaaaaaaaagaaagaaagagatgtggattttgggtgggggacagagggaagaccatggtaggcagaatgatcctctaaaggtgctctgccctaatccccagaagctaagaatatgttagatgtcagtattgcgtggcagtaggaatcttaattaacgttatagactgttatggtttgaatgtcccctctaaaactcctgttgacatttaatcatcattgtgattgcattaagaagtggccctgttaaaaggtgatttagtccttaagaacgctgcccccgtgaatagattaaggtcagtcttgcgggagtgtgtttatcaagaatggattgttaaaaagtgagttctggccaggggcagtggcttatgccactcagcactttgcggggccaagacttgaagtcagttgtttgagaccagcctggccaacatggtgaaagtctgtctctactaaaaaatacaaaaagtgtccgggagtggtggcgggcgcctgtaatcccagctgctcaggaggccgaagcaggaggatcgcatgaatccgggaggcagaggttgcagtgagctgagatcgccccgttgcactccagcctgggtgatagagcaagactctgtctcaaaaaaaaaaaaaaaagaggaaagaaagaagaaagaaagagaaagaaagaaaagaaagaaaaggaaggaaggaaggaaggaaggaaggaaggaaggaaggaaagaaagaaagaaagaaagaaagaaagaaagaaagaaagaaagaaagaaagaaagaaagaaaagaaagaagaaaaaaagaaagaaaaaagaaagaaagaaaaagaaagaaagaaagaaagaaagaaagaaagaaagaaagaaaagaaaagaaaagtgagttctgccctctcttgctggcttactctcaccctctcttgcccttccacctgccaccatgggatgacacagcacaaaggccctcaccagatgccagtgccatgctcttggacttccaagtctccagaaacatgagccaaatacacttctgttcattataaattacccagcctgtgatattctgtaataacaacacaaaatagactgagacatagatcttcaaatagtgaggttatcctggataatccagatgggcccaatctaatcccatgagcctttaaaactttctccagatggaggcagaagagaagtggcagaaggggaagtcagagagatttgaagcataaacaggactccatggtgccgtttctggtttgacgatggagtggtaacgtgatgaaaaatgtgggtgccttccggagctgagaggctcccactaacaatcggccaggaaacagggaccacagccctacagccacaaagaactaagttttgctgacaacccaagggggcttggaagtgtcttctcccccatcggttccagatgtgagacccagagcgaaggaaccagctgagcccacctggacttctgacctagagaactgtgagataataagtttgtatcatttttaaggcactgtgtgtgtggtaatttgttatgacagcaatagaaaatgaatccagatgggcaggatctgccaggccagtgacatgtggagggcacccaggcggatgggatggcatgagagaaggcaggtcagcaatgagcttgcccaggtcacctctcctctctaagcctcagttttcctctctatgaaatgagagtagtgatatctccctcccagggtcagtgcaaggctgaaataacagattataaggtgctaggtgcacaagaagtgtttgaaacatgctagttgcttttccatttccaagagagctctctggtcttgggggatggaggcagtgcggcccctcgggattactgacaggtcctgctctgtttctgcagtggagccggccccacctgtcctggtgctcacccagacggaggagatcctgagtgccaatgccacgtaccagctgcccccctgcatgcccccactggatctgaagtatgaggtggcattctggaaggagggggccggaaacaaggtgggaagctcctttcctgcccccaggctaggcccgctcctccaccccttcttactcaggttcttctcaccctcccagcctgctcctgcacccctcctccaggaagtcttccctgtacactcctgacttctggcagtcagccctaataaaatctgatcaaagtatgatgacctacaggaggcctgcttgccaagtcaacagattcagtacagaaaaactgaaaaatacagataagctctaagaagcagaccaaaagtacccagagatgaccgcacatcactctggtgtatatccaatttcagatttgttttctgtgtatgcatgtgtgtatagctgcatttatttatggcaagggctggcagactttcccgaagaaggccagatagtcgatatgtttggcttcatgggccgtatgttcgctcaggactactcaacgctgcagttatagcacaaaaggagccgtagcctatacgtaaatgaatgggcatcgctgggttccagtaaaactgtttacaggccaggtgcggtggctcatgcctgtaatctcagtactttgggaggccgaggtggtgggaggattaccttagcccaggagttcaagaccagcctggggaacatggtgaaacattatccctacaaaaaaaaaaaaagctgggtgtggtgatgcatgcttgtggtcccagctgcttgggatgctgaggcaggaggatcgctcgagcccaggaagcaaggccacagtgagccatgatcgcaccactgcactttagtctgggcaacagagtgagaccttgtctcaaaaaaaacaaaaaataaaactttttacataaacaagtggccaaccagacttggtccctgggcctctgctcttgaatgttcttgcttccactaaagtaacattcacactcccgatttttgcatactctgggttctggggaatatagatccgaatccagcgtggttcctgccttcaagaacctcacaaatattctagaccagcactgcccaatagaaagaaatataatgcaagccacatgtgcagttttaagtgttccatgttaaattaagtaaaaagagacgggtaaatcgaattttaataacagattttacttcatccaattgaatggtatcatttcaatgagcaattctgatagtgattgagatcttttacattctttttcactacgtctttaaaatctgatgtgtgttttgtacttggaacacttctcagtgtggaccagatgcatttcacatactcagtagtcacgcgtggccagtgccttccataccacacagtgcagcatctgtagaggtttcctccactgctgatagactaggagaccccaagatggaaagcctgaagaatctgctcctcgaagtagggaccttaatggggtgcacgccagggcgaccccaagtggtaggctgcttttgaaccatggctatccctacctctagactcagctgaaaagaactcaggtagtcttgggaagtgcttcctcaatgcttaaactttaatgcaggaaaagaatagaaagttcaggcaaggagggaggatcacttgaggctgggagttcgagaccagcctgggcaacagcaagaccttgcctatacaaaaaataattttaaaaaattacccaggtatggtggtgtggatctgtagtccctagttacttggagagctgaggtaggaggatcgcttgagcccaggagtttgaggctgcagtgagctgtgatcacaccactgcactttggcctgggtgacagaaccaaaccctatcccctacaaaaaaacaaaaaaaaaaaacaaaaaaaaacaccctaccatgtctgccaaccccactctgtcctggctgtgtgaaaccagtccccacagcagctctgccactctctgcttcttttccaaacagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccaggtgggtatcaagtggtgcagaaggagaaactttccctctgggccttgggagcttcgtgacacagtggttaagaacatgagcctagagatagactcgcctggattaaaaccacactcattgtgtgtctttgggcagcttacataatgccccgaaccttggtttgcacagtctgcaggatgggtttattcttgtgaggattaaatagggtcatgtatgtgaagcactcggcacaggtgcagttgtagacaagagccattgttgtttctctcattgttatttttccttccttagaagccaactgggctttcctggtgctgccatcgcttctgatactgctgttagtaattgccgcagggggtgtgatctggaagaccctcatggggaacccctggtttcagcgggcaaagatgccacgggccctggtatagcaaatctgggggtgtgcggcaggtggggaggggttgagagtaagggagtggggctggagctatgagttgttcagatagaatatcaagatggtccagactcttggaccaaaacatctatctttgtgtctgaatttccaccattagtaatgcattcatttagtcctgaataaaatggcaaacaggccctggagggagcagtgccttaagttcctttgagataaataacttcacctctgctaaggatgtgtcagctgctgagagcagagcccctggccttggacctcaggagagacactcaaaaggggaggagaggaggcaccaaaggggacatcttaaaagagttccaatttttagttcacactttaacccaggataagctgtgtcctggctgaccttggagtttcttccctggtctgctgggtctctcccttagaacctaggggcgagctggggcaggggaagcccaggaggtgatataggtcggccctgttcagatgagggctggcaggggcagcttgggcatatgcgaggctccgatgggcatgggggctttgaggatggattctgagtgtccctgcatcgtggcagggtggcaaagggagcatttccaaatttcctggctccaggatctgtgggagaatcccactaactgtcagggtgacaacctcgggtagacatgtctgtgccctgccccgtgccctcagccttcctgttaagagcacaccagctggatttgcaactcccagcgcctgcacccaatgggctttctctggcctctggagcccacattgcccctgcatgtggcaggctgcaagtgtcacagccaccagctcttccattcctcaacaatgactgtgggtaaatagcccaggagcgtccccctcctgggatggttctgaggtgcgtgtgcccagtggctccctgagttgccagcaggattaagtgccagtagccctagtggtcagctgcttgataacaccctgcttcctggctgctcccccagtcccatctggtgtgttctgggatcatctcccaaagaaactgcttacacttgaagccttgtctgaggtctgtttctaggggaattcagatgacgataattatgcttcaggaaagcctaaattttctgcttttctctcccctacccaaatcaggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatgctgctgctgcctttgcaaggactactgggcttcccaagaaactcaagagcctccgtacctcccctgggcggcggaggggcattgcacttccgggaagcccacctagcggctgtttgcctgtcgggctgagcaataagatgcccctccctcctgtgacccgccctctttaggctgagctataagaggggtggacacagggtgggctgaggtcagaggttggtggggtgtcatcacccccattgtccctagggtgacaggccagggggaaaaattatccccggacaacatgaaacaggtgaggtcaggtcactgcggacatcaagggcggacaccaccaaggggccctctggaacttgagaccactggaggcacacctgctatacctcatgcctttcccagcagccactgaactcccccatcccagggctcagcctcctgattcatgggtcccctagttaggcccagataaaaatccagttggctgagggttttggatgggaagggaagggtggctgtcctcaaatcctggtctttggagtcatggcactgtacggttttagtgtcagacagaccggggttcaaatcccagctctgctcttcactggttgtatgatcttggggaagacatcttccttctctgcctcggcttcctcatctgcagctacgcctgggtgtggtgagggttctaggggatctcagatgtgtgtagcacggagcctgctgtgtcctgggtgctctctacgtggtggccggtagaattctccatctatccaggctccaggagacccctgggcatctcccacctgtggcccctaaacccagagtgactgagagcacttaccattcagcttgtctcatccccagtctacctccttccttctaccctcactgcctcccagtcaggagagtgagctctcagaagccagagccccacccaaggggaccctggtctctccgccttcacctagcaatgggaaccctgcttcccaggggaggaaccaactgctccaccttctagggacccagtttgttggagtaggacagtaacatggcaggaatcggacttctgggcctgtaatcccagtttggatggcacgttagactcttggttgaccgttgtggtccttagaagtcccattctcccttccagttatgagaaaccaatgccttctagattcaggtgactatccttacctgggggtgctgatgcatcctcagttaacctacacccacctgaatatagatgagcgtagctgagttttcacccgtaggaccgaagtgttttgtggtggagtatctgaacaaccttggctctgtggccattcaacctgccaggactaacatttctggatttgtgaagaagggatcttcaaagccattgaacccacagagctgtgttgctttaaagccaccacaagggtacagcattaaatggcagaactggaaaagcttcttagggcatctcatccagggattctcaaaccatgtcccccagaggccttgggctgcagttgcagggggcgccatggggctataggagcctcccactttcaccagagcagcctcactgtgccctgattcacacactgtggctttccacgtgaggttttgtttagagggatccactactcaagaaaaagttagcaaaccactccttttgttgcaaaggagctgaggtcaagggtggcaaaggcacttgtccaaggtcgcccagcagtgctgctctgatgacttgtgcacatccccaagggtaagagcttcgatctctgcacagccgggccaacctctgaccccttgtccatgtcagtaaaatatgaaggtcacagccaggatttctaagggtcaggaggccttcaccgctgctggggcacacacacacacatgcatacacacatacgacacacacctgtgtctccccaggggttttccctgcagtgaggcttgtccagatgattgagcccaggagaggaagaacaaacaaactacggagctggggagggctgtggcttggggccagctcccagggaaattcccagacctgtaccgatgttctctctggcaccagccgagctgcttcgtggaggtaacttcaaaaaagtaaaagctatcatcagcatcatcttagacttgtatgaaataaccactccgtttctattcttaaaccttaccatttttgttttgttttgtttttttgagtcggagttttgttcttgttgcctaggctggagtgcagtggtgcgatctcggctcactgcaacctccacctcccgggttcaagtgattctcctgcctcagcctcccaagtagctgggattacaggcacccgccaccacacctggctaatttttttgtatttttagtagagatggggtttcaccatgttggccaggctggtctcgaactcctgacctcaggtgatccgcccgcctcggcctcccaaagtgctgggattacaggcgtgagccaccgcgcccagccaaaccttactatttttttaaagaattttttccagagtttaatttctgacatagcttaagttttccagtaactctaaactccatctcctttatcgtcattaagtcattcacaaaaagccaggagaagcatttggaaagggcatgataatcagtataataatttgccttgtgtggtcagcacttaactgtttacaaagccctttcacatgcacagcaggtgggaactgcgcggtgtgggctgggcctgtgctggaagcatatcccgtgaaaagtgttagtgccttaggtgaaagcaacatgtatccctttagactactaacggtatatgttgttcttatgtatttgtatttatttctattttttctatgtttatgtcatatttaaacgatatcctactgcttgttggtattaccctaaactgtttaaataaagagctctatttttaaagaaaaaaggtacaattgaatggaaaagcgtatgctcttatcttttttttttgagacaggatctcactctgtcatgcacgcatgccccaccaggcctggttaatttttttgtttttgtagagatggaatctcctatgttgcccaggctggtctcaaactcctgggctcaagcaatccttcccgcctcggcctcccaaagtgttggttgggattataggtgtgagtgaccgtttctggcctatgctcttatttttcaaaggctcctcacctctcctctgggaaacctagctgttaaggctacaagggtcagccaggcagggtggctgatacctgtaatcccagcactttgggaggccgaggcgggcagatcacgaggtcaggagatcgagaccgtcctggctaacatggtgaaaccctgtctctactaaaaatacaaaaaattagccgagggtggtggcaggcgactgtagtcccagctacttgggaggctgaagcaggagaatggcatgaacccgggaggtggagcttgcagtgagccaagatcacaccactgcactccaccctgggcgacagagccagactcagtctcagaaaaaaaaaaaaaaaaaaagactacaagggtcttgagtcgggtccccagaagcaaacccagagaaaaggtagaaaggtagaaagcagtgcagtgatccaggtaacgccaggaggggagtgtggaggcaagatggggcggagggtaggggaggaggggagtgtggaggcaagatggggaggagggtaggggaggagggcagccaggcaaagtgtgtcatcaacaggtccctgctgtgggcagctggacctcagtgcccctggagagctctggaagtcaatgtaggatgcaattcagatttggtcccactgccaggggcaggagccagggagtctagctactccctcccatcagtccagtgtggaggccgttccctgaggcagagttgcaggtacttgcagttggaatccaccaagctgagtgcacaagaaaggggagtgccatggggctgagggcagggtccccagccaatatcccttgttgtagtgaggctggagctgacagctcacccagctgcaactatggtccatggaaggatatggaacagcacctgtgcgcctagctttgcattgccaaactcattccagcagctctccattagcaagggtctcccagtttccagcaactctctcaaggccacctggtgactgtctagcactgtgcccgcagttgtcacctcttattggtgccagggcaggcgctagacccaagcctagctgatctgacaagtccctctccctggaattcagtagtctccctggctggctgggcctggagcaggtaccttccaatctgccatggccgcatttcccagtctgaggaacagtctgcagacaagacaagaaagcagccactgccacgtgggctgccgagacaagaaacggcaacccctgcttctggtcccttcccccaggtgcagctgcaccccagcctcgacttcatcccacttttaaaaatatttttttctagatagacagagtctctctctgtcacccaggctagagtgcagtggcgtgatctcagcatctcagctcactgcaacctccaccccccaggttcaagtgattcttgtgcctcagccacccaagaagctgggattacagctgtgcaccatcacattctgctaattttggtttggttttttgttttgttttgtttgttttttgttgttgttttgttttgttttgttttttttgagatggagtctcgctgtgtctccaggctgtagtgcaatggcgtgatctttgctcactgcaacctcctcctcccgggttcaagcaattctcctgcctcagcctcctgagtagctggaattacagatgctcgccaccatgcccagctaatttttgtatttttagtagagacggagttttgccatgttggttttttgttgttttttttttcagtagagacagggtttcgtcatgttgcccaggctggtctcgaactcccggcctcaagtgatccacctgcctcggcctttgaaagtgctaggattacaggagtgagccactgtgcccagctagtttttgtatttttagtagagacaggttttcgccatgttggccaacctggtcactcccctcccaaagtgctgggattacagacatgaggcatcatgcccggccccttgcaacccacatacaagtccatgaaagaaaccagaatgtgttacccccaaatatgcctctttgacacgataattttgaatattttttagctaaggtagttaaaaagcagcaaacagaggaagagctcccctctttccgccgaaaggcaggttataaattctttactggagacaacttttacaaaccttatgccatcagtttactcccatgcacttaccttctcagaggtccctcctttgggagcctaaacctgctttcctttgtcttgccacttctctaaaatgtattgtgtgttttttttttcctgttcccgttgtgggatatgatgaggtttctcttcaaataatctgatccatcttttattctttaattcatagtacccctttttctcctttttgcctttgttagatgcccaggcacaccacagtaccagtggttatcagtaccagctcacattcctttccttatttggaaagaagactaactttctagctcatgacagacaccccttccccgccctctccaatttcttttacgtgcccaccttatgtaaaaaaattcaaatgtttagccaaccgggattcgtttagattgtacgaccggaccccggccaatggggaaagagtacaggggcaggacttgcgtcagaattaaaggctctcttgccctttgttcaggtgtgctctcatggcgactggccaaggaggcacccgtctgcgcagaagtaaaattactttgctaagaatcctttgttcgagtgttcaatttccttaggattttgagcgttattcctgacagcgttttgtcaggataaaatttattgttctttgttgaagatgctctctaagccagagtcataagccactgcaccatcacctttcttttgaggtttctccctcgtgatgtgtgctgcacgtattacagacttgcttgcttttctcttggtaatctgtcttttgttacagggcgatctgtctctactatgaaggggtgagaaattatgtttcctcccccaccccagcatttaagccagggccttctattacttgtaaccaaatgtccttgctaattcacaaagacaaggagacagtgaatccacctcccgggttcaaacgcttctcctgcctcagcctcccgagtagatgggattacagacacccgccaccatgcccgcttgtggccagcttcgggtatctggtcctttccaggaaacagggaaggacgtcctctccaggtgacccgcccgccctcctcctcctcctcctactgctgggtcgccgcccttgagcttctccgaacctgtctgctgccacctcctggacagtggtggtatgtcagggcggctgggcgcggtcttacccgaaccgagctcagggaacctggagaggggagggctggggtaatggacgccctgaaaacttcctttaggaaaggggttgcttttcctcttggcaccagcacctggcacagagtggaagcttgggattgagtaagtgaatgaaagaataagtgagtgaattggcgtatgaattggagtcagtaagtggacggctgtgactgactcacatataaggttgcaggagctctcgcatgcgatgataccatcctgatcccaaattcccgttgcccgtcggtgcccgtcctccctcgcccagcatctgctctgagggggcactggtgctgctcagcgagcatagtgatgttggagggagtacgcgggagacagaacaggaccttatcacttggtctgggacttattattctgtaattgattgtttcccatgtgatttaggttttgatcaatggctgcctgcgcatcttccctgagctcattcctgtgtgcataaagtggggctgaagtaatgagggttgggggtgttttttctagaaaacagactagaagttatatctaaatgcgtgagtcagctccatgagtcagttcctcaagagatactggttgacaccaggaccggttccagccctgggagccccacccttggcgtgtgacgatacatgacatggaggtgtgatggctttatataagctgagtctttttatttcccccaactgcttatttaaatggatgaagaggataaggtcacgaggagtgccctgtcctggtggacaaaaccatcagcatatggcgagaggcccctctctaggagggcggtgcctccagggtgggacatatcccaccccactctgagtctgtttctccaggtgctcagtggaccatctgggaagccagagtccagtaggagcctggagcccccacactcccatctctgagctccaggccctttcatgaaagcccctgcttctaagtaactctaacccagcctggacgcctaacctgcaggatgcaatgccgttactttctccagccctggaatcgggcctcagaaatgatggccaactcaaacttcttttttttttcccgagacggagtattgctctgtcatccaggctggagtacagtggtacaatcttggctctctgcaacctccgcctccctgttcaaatgattgtcctgcctcagctgcccgagtagctgggattacaggtgactgccaccacgcccggctaatttttgtatttttagtacagatgagtttttgccatgttggccagactggtcttgaactcctgacctcaggtgatccgcccaccttggcctcccaaagtgctgggattacaggcgtgagccaccacacccagactcaaacttctaagggaatgttatcattgccctcatgcccacctccctccatccccacacctgcacaccagcagtctaggttttttttcttttttcttttctttctttctttttttttttttttaaggcacagtctccctctgtccccaggctgaagtgcagtggcatgcaatcttggctcactgcaacctctgtctcccgggttcaagctatcctcctgcctgagtagctgggactacaggtgcgcaccaccacgcccagtgtatttttagtagagaagcggtttcaccatgttggccaggatggtcttcatctcttgacctcgtgattcgcccgcctctgcctcccaaagtgctgggattacaggcgtgagccactgcgcccggcctgcaaaggtttttaagggaactcattggtccttgggttcctcattttgtaacagaggatgcttgctgcgtgagacctccttctcagaaatggtccagagacagcaacccagcaacactgaggagtagagacttatttccatttctagatgaggaagctgaggacaagaggctaagggaccctcacacagcagggaagtggcagagctagaattcagaccgggtctgtctactcaaagcccatgttccattcacttcccttggctcctgtgggggcctatgaaagtgctcccccatcctggctggaaatgcatgatcttcttaatgtttttatgaagaagcatggccttatacatgccttataggcatgtaataagcttctggaacttcaaactcccaagagagagctgaaattataagtagagtcaggaaattctacaatgactttatgtttgtgtgaatgacattggtcatgaagggaattctgggatgtcaggggaggtttccaaccccaaagtgacatggaagcagaggccatgcaagctgcagaggcccttaggagacttctagaccaagcctcctttacagacagagaaactgagacctcaagaggggacaagagctattcatagtcacctgaagtcaggtgcaaggttgtgaccagacccagactccggacctggaccatgtactcaatgtccctgattgacacagcccaggccttggagtcagatgggctctcaggcttcgttccttgctcctgctctccaggaatgagcaggaacccctctaggacctgcccctgcagagtcatcaaccatggagacagcactccacactccctgaagacttccgggaaacagcccactgccttttgatgttgtgcttctgttattcctgggtgttgagagaagggacaggagcagatcacattcccgagtagttcattgtaaaatgtgctttttctatagcttggggatgttccctac

SEQ ID NO: 67 - DNA, 672 bp, Homo sapiens
gggcccgagcgctggggccccctgctcctgtgcctgctgcaggccgctccagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctgg

SEQ ID NO: 68 - protein, 185 aa, Homo sapiens
  VARIANT (1)...(185): Xaa = Any Amino Acid
MMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALX

SEQ ID NO: 69 - DNA, 700 bp, Homo sapiens
catggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccaggacttttctggacacacacaccctgtggc

SEQ ID NO: 70 - protein, 234 aa, Homo sapiens
  VARIANT (1)...(234): Xaa = Any Amino Acid
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPGLFWTHTPCGX

SEQ ID NO: 71 - DNA, 684187 bp, Mus musculus
  misc_feature (1)...(684187): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaataggaattcttaattaatgagagatgctgtgtgttgagaatttcaagatttctttcaacctttagaaatatgaagattatctgtttttttggttttttctgaggaaaatccttaagacttagggtctctcacttttgcttccttcctacaaatgcttcaaactctctgctctatcttaaaacaacaaactggattgtttcaggatttccatgggactctcttggccaataattcaattacttgcaacctgttcccaatactgaaaacctcatttggttagcctgctgtgagcctatatctcttattattagaagactttattaacatcagcttcaaatattttagtaagtttctactgcactgggttctgtatcatttctccaaccccctcaattctggatacctatccttatattccatcccaaactggtctgtttttatgtcaataacatacagttttatttccacagctctgaaatacaacttgaaattaggaatggagaaaccttcagaagttcttttattgttcagaattgattttactattctattttgttgttgttttgttttgttttgtttatatgaagttgagaattttcttttcaagaccagtgaaaagttggggtggaattttgatgggagtgcattgaatctgtagattggttttggtagaatggatatttctcctatgttaatcctattgagtcctgaacatgggagatctttccatcttcttataatttctgcaattttattcttcaatgtcttaaagtctttatcacacaaatctttcagttgcttgattagtttccccaagatattttatattatttgaggctattgagaaggcatttttcctgatttctttctcatctgcttgtcatttaaatataggaaggattttgatgtgggggagttgaacttgcatccagctattttgctgaaaatgtctatcagctataaaagttccctggtagaattttagagtcacttatatatacactattaaatcatctttgattaaaaatactttgatttatcctttccaacttgtatctcccatctccttcatttgttttattgttttagcaataggtaaatagagtggacaaattattttgtacctgattttaatagaatttcttttatttttccatttaatttgttcttagcatcagcttgctgtatttttattatgtttaggtatatttctttatcatgtttaggtatgtccctttattatgtttaggtgtgtcccttgtatcactaatctctctaggactcttatcatgcaagggtgttggaatttgtcaaaggtcttttctccatctaaagaggatatcttgtgtttttttttctttcagtttgtttatatgttagattacatttactgattttcatatattgaatcatcatccttgcatatctaccatgaagcctatgtgatcatggtaaatgctttttttgttgtgttcttggattcagatcacaatatattattcagtatttttcatctgtgttcaaaagggaaactgatctataaatccctggaggagaatatctttgtgatcttctgtttggcatgggtcatagaagaaaagagctggggatgagattgtgggtgtagatctggaagataagtaaaagaggtgtgtctgcctacttgttgcccaggtaagagcagctcttcggttagcagaaggtgcctactgcagttggtggctgggacaagccagtgaatgggggaagtgaagttagaaggggaggatctgtggggtccacaggagatgggaggaggtgtatagggaaggctgttacaggtgttctgctgcagagctaaggatgagactgatttttacttcttgatctattatagtactatgattattatctggcatctctaataattgcatttttattattttcatcacaataccatgagcatttataacattccctagacgacaatgagatcagggtagtaaatgacatactctaatggagagacaagacaggttaagcatagagttttcattaactcatttaaagtctgactggtattcataattattttctatcttattctttatagaagatgctgatcagatagattccaatacccaaaggaaggtaacacatgaaaagaaaattctaagtctagtataaatatagctggagcaaggagaaatgaaagcattacctatacagctctgtacttcctttcacttcctcagaagaagatgccttcttaaaaaggacatctattttagtacaagagataaaaaggggcatttacagggtaattataaaaaaggcaagttagagtaaactaagtggtgcatgagtgcatgtgtgtgcacatgtgttttaagttatagggtgagtgagtcttgctacttggaagcacaaatttctgtaatcttagaagacaaggagaggttactagagaacctagagtcaatattactgacattcctttttatcctagttgtatattttttcaacattttcttttagaaatataattgctaaacctatttgctttactctgaacaaggtgtttacattatgcaaaaactacaaatataaagatatacaagtatatcagattatcagaaggatatttaagaggtaaggatatatatctcaagggaagggtttatcttttaagtgcagataagtataaatgtgtgtttattcccagcaggaacacacacacacacacacacacacacacacacacacacactttagagagagagaataagagaacgtgaccaagacagagagtcagagagagcatagagctttattaattaattatattcagtgcagagaagatcaacaccagatcattactccaatatccattgatttgccctcattttggatgttgttgcctaagacatgttaaaaagagacaaaaataccatcatgaattggagaggtagccacaaaatcccactcctgaggacctgttgataattgataactaccagaagagggaaaattagcatttttaaagagaatggctcttaagaggtctaatatccttcatttaatggctagatacatgagaatatatagacaacatttataggactcagtgattttttttaatttggaacacacaaacttgtgttgaatagaatgggcattaaatttaggatgtgaagaggcagctgaatgtgatcaaaatataatgtatgacactataattgagttatctctacttttaaaagactatttttagtttctctggatatctaattctcaagaacattttcatatttgtagttataccacaacaaattggcccaagactgtgagagactagaatccctaaagactcatttgaaatatgatttacttaatctccatattgccattctaagtgacagattgtctttgtttattcaatgatataggaaattgttgaatcacccttattattgtgtattacctgcttttcccaatttgtaagtttgtatgctaaaatactagtttatgaatgttctattctcctgtacatttccttctatcttgttaacaagaatcaaatgcattgtttgtacaatgtatacaacatgcaaagcatattgttgtgtttaaattaggagtacctgctagaatttagagactgaaatataataaaggctaaactatagtattcagtttttgtttacctcggaaccagcttttttctcataaacaggcaatgctatctcagaaggaatgtgattacagcaaagcaaagtctacacccacataaaatgacctactttgagaggctgatagatgataattttcaggcctatcagacaaagaatttctagacactgggttcctgataattgacagagcctcctgagaaacatcaatccttaacacccactcagatcactccaaaatatttgaaagcactcttccaaagttgttacattatgaatatttttaaacgtaagaatctgaaagatttacaccccatgataaatttgatctggaaagtaaggttggggacagtgcacttagtgaatggaagttgaatgccaaatttagcttttgttgaagcttattattctcagtactgatagtttgaggtcgtttctgctttcccctcaaaatgacacagactataattacgctagctttcaattatgaagtttatattttgaaagtgaatctgacagtgcctattcaaaatctagcctcagtcttttgttcagtgcctgtaatcgattatgcacatgccctgtattcattactgataagcatgtctttagctttgagtttcttttcattcataggacaaaatcaatggatgccactatgccagacattcactaatattctggttagtgccatttagagaagtggaaaatacaagcaaacactaactctatctgctgagactttaaaaactcctgtctattttcatagcctaaaaccttttaatgagaacattattaaaaacatttcgaagaccttgccactttataaatgtggagctgttgatgtcctctttggttgtgacaactgtaaaagtctgtaacaagggcaaaaaccatgttacaaagtaaaatgaccttactcctctctcttgctctcttgctgtttgtatttactcaattccctgctcctgcccatttgtacctctgaaatttctgacaaatgttaattttaagctatatctgtctgaattcagaccttcagcatatgacttccatgcttaaggcctttttctaatgtatattctgacccaaaattccacacagtatattaaggggaaaactattaacgtataaaagccagtctctgattgaatgcttcaaggtacaccattgctcttacaaggaatcaaaacatcattttgacctctcataaactccagaagcttcctttgtttacctatttcccttatatcttttttttgtcttaaatttgaaatacaagacaaatccattagcagtacttgtaaaactatgcaatatcttacttgtgtggctttgtttttctcttcatgcctgtacctgcatttctctgtctgttctttgtatagtcaacttgctaaaattccacatacatctccaatatcacctttccatgcaatactatcagaaccattcatgtgaatttcttattactctattcccacattatgctacaaagttttgtatatcttcaacaggactgtgacctcaaatgaacctggttctcaatacataaatatataatgtgttaggccatactcatagaacataacccaagacaggatttggtatgcatgtgactgatattggaagtcatcttatggaaaaaaagtacatggatggggggtgaggacaaggaagctgggagttgagtaagaagcaggaatcttgttaattctagggttggcaataccttaagtgcttcactacacaattatcctcttgggatactgtcttttgtcagtagggcatactcaaaagggtcacaatttccctgaaaggtggcttttctcaattaaatgtaaatttcaaagagaaaaccactgagttgtgagtattcaacattcacaaattagctagaaacaagattcatcctcttagtacaagagaaagaggattaaacatttctgagaaaatcattgatgtctttttttttcaacactgacatttagtttagtttaaacaaaggaccatatgcatgcccatcaagcacccctaccaattgaagtacaccactttttaaaagttttttattctttcttatttcctttttcttttatatatatagagtctagctaagtagtacagactgaccttaaattccctgtatacctcatgatggtcttgatcacttgattctcttgactcttgtgaattacagacatgtgccaccacacctgacgcttacatattcatattaggatgcaatatgtgtgagttctatgattagattattttttagaattcaacctttaagcgtgttgccatggaaatattttgagctcttacatatgtaggaatagtgacttaattaaaatactttttctaatctcatttgaatatattgacattttccagtgtatatagcttttgttcatgaaatgatacttcagtatgaactctctggaaagcaattagttctgagtcccaattctatcactgccttcaccttagttttaaaaatttagagtggcataagaaagaaataaggatatcacattcttcttttattttccaacatagttttctagcttcataagctcccattggttttaaaggaatatgcactgcagaggtgtacacaaggaggctattctcatggaatcttttcaatgaaggttgagcttcttaatcaagactttatagaaggagattttattatggaagaaagaaaaacagatcacatatcattgctctctacaattactagtaatatttttaatcagaagatgaaaatttggaagtttacctcctaacttacatagccaaaagtatctagaaatatttttactgattttttccaagtagaacatatgccttgaaataaagaaaaacctgaaggaactgaatgtttcaatcgtaattttcgtcagtaccagtaaaattttatgtaatcacatgtcctttcaagatctgagatgtcttgctacacaatgttagaaagtactttgttatacaatgaaaacatctcttaaggagatgctgctctatagtagagtgaaatgtcatcattcacctaatttagtttatacttattaatggaaaatttctccttttttctttccttataaaagaaaaggagacattctaaaaataatgaaagccaccagaaatattgaaagaaaaaaaaacaattctgtcatttatttaaatatttattcaaatactttgatagaccttaacatgatcatttttcatttgtcatattttttcttagaagttactgacaactcaagtatacagatagtgttgatgtgtcagccatgttagaatctgttgttttgtatgtatgtcaggaagggtatattaaaagatgctgtctccagatatcttggaatatgcctgctatactacgatttgccagctgaggcaaatggatagcagcttagacatatggcaagtcccaggtcatgattgctacacaatgatagtttgtctgaggaaacaattgtcttaagattttcattgggacatggtactgacatccaacaaaatcttaccccttggcttctttatttgcctccacagtttcatctttttaaattccttggtgttctcagcagtcagagaagtaactgcttgcttctgtctctgattgtgaaactgctatcagagatcaattcaattaaatttatttcttcacataattcataactataacatattcatttctgatgtgttatatatatatatatggatctaatcagtgaaagaaatgtcattgtaattcaaacaaaatttctatcataaattatcaaattatagagaattatcaaatgtaaaagggtattgtaatactaaagggatacactaatatcaagaaaaaatacattattctccttgggttaccgtaacaaaatataatagatggtgtggtttatatgatgatagcttatttctcccagtaccaatacctgaaaagcccaatatcaatgtccgaatcaattcagttgtagtgatggctctttatataacctagaaatgtctacctttgttctgtgtacttacacaatgaactctttgtgagtcccagttgaagaaagaacaagctttcatgtctctacatctaagggcactaatcctatcagaaggagccacagacttctgacctaatctaattccaaatacccatctccaaacactaacatagtgtgttgttactgcttccctgtatgcagggggagggggttacacaaacannnnnnnnnnnnnnnnnnnnnnnnnnnnnnnnnnnnnnnnnnnnnnnnnnnnnnnnnnnnnnttcacttcacagcaaaagagacccttaattaatagtagaccagttgcccttgtcctaacaaataaaatggaaattccaagtaatggatctcattatttttctctcatcagagcagagatgcaaacattattgagaaaacattgccatgctttctctaactgaatgttagatgtcatagcgtttcttcattagcacaacttaatggcaatacaacagccccttggggttgccaggaacattctgtctaacgttcccaggagaaatattctttaagaaatgtttcacctgaagaatagctttttttcttttttacaaatttgctgggtaccattcactttaggagtcctggggaagccctatatgctgcaaaaacctgcaagtaggcatgggaaaagagcaatttctctccagcctcctctactgacaaagcttcagtacatcagaaaaaagagaaaaacaaaataatgtacctatattttattttcagaactttatcattactggaaagttgaatttccattttttttcttttcttcttttttaaattcattttacatcccaatctctgtcccgcttcctgagcaccactccaggccagatggccatgagaatgaatggaatgtagaactggtgggggtgaggaggtgagggacatcactgagggtgtggcagagaccaggataggggaggctcccaaagaatcaacagggaggaccttagctgcaactcacagcattggggatatggaacctgaaaagatcacttcttgcagccaggcaggagccccagtggagtgattgggacaccaaccacccacaaaatctttgaccccaaatttatcctgtgtacaagcaattcagggatgagagatggagtagagactaagggaattgctaagcaataagtggtccaactagagaactatcccatgggcaagcaacaatccctgacactgtgaatgatactagattatgcttgcagacatggttgtcctctgaaaggctccacccaggagctgactcagaaacttacagacacccacagccaaacattgcatggagcttgaagactcttatggaagttttggaggaaagactggggtccacaaaaggggtaggagctccacaagaaaactagtagagtcaactaacctggacccttggtgctctaagagacctaaccaccaaccaaagagcatatacattctagacctagcctactcccctcttcctgttccccacatatgtagcagatgtgcagcttggtctttatgtgggtcccaaacaactggaaaaaatattttgaaggccaggatttatttttacagagcaagctaagtagtatatctataactgattaaaaataaataatgagcttagtaatacaaactaaaactaaacaaatacaatgtttacagcagagtatactacttttgaggacaaaactctgtgttatccattactgtatattcgatgtgtctagaataaatctgactcaatacatatgctctgtaaacagttaagtaaatgaatgaataagtgtattgttaattcttttctctaattattttcttctctctcctctctttattactacagctgatggatgcacagattggtctgttgatatcaagaagtaccaagttttggtgggagaacctgttagaatcaagtgtgcactcttttatggttatataagaacaaactactcgctcgcccaaagtgctggactcagcttaatgtggtataaaagctctggtccaggagattttgaagagcctatcgcctttgatggaagtagaatgagcaaagaggaagattccatttggttcagaccaacattactacaggacagtgggctttatgcctgtgtcatcaggtactctttttaattaaattatatttgactcgatgaaactacgcagaattttctaatacttaaagtttcctgctgtcacattcaattacatgtattgtctcaatatttgcatgtgttgccatgtattacgttttagaatgtaaatcataaaaaaatgggattggaatttatattgagacattatttcaagcttatggagaaaagagataccatctggttatctacttctgttgccagaaattactaaagtctaggaaataaaatttatagaggaaataaaatgttgcaaataaaatgtaagcaaagtcttgcagaaaagatgcatagtttactgctaaatgggctgtaacattttgttattgcccttctcagacagacagagcagggacacctctgcttaatgcacatctgcaaagatgattttggtaatgctttgcgtgtgtggggggggtgcttgaatacacacaggaagaagattattcatgctatattagggattataaagtttctgttctagaaagttttgttaatgacaatttccaataatataaataagtcccaagtctcctttggcaaagattaaagtcagtaacaagtgtttgttatcacccctaagtgaattaattgtatatatatatatatatatatatatatatatatatatatatatatatctttttcagactagaatgaaaagtttaaaattcacttaaaaataatgcatcaaaacagtatccatttaacacattaacagttaaaaaacatctctgtagattgcttttgataagatttccattttatgagaatgggagatcattccatcttctgagtttttttgatttctttcttcagagacttgaaggccttgtcatacagatctttcacatgcttggctagagttaccccaagatattttatattatttgtgactattgaaaagggtgttgtttccctaatctctttctcagcccctttatcctttgtatagaggagggctactaattagtttgagttaattttatacccagcccctttgctgaagttatcgggtataagatctctctggtagaatttttgggatcacttatgtataccatcatatcatacataaataatgataccttgacttcttcctttccaatttgtatccctttgaactccatttgttgtctaattgctctggctagaacttcacatcaagtactatattgaatagactgggagagagagagcaaccttgttttctacctgaatttagtctggattgcttcaagtttctctccatttagtttgatgttggctaccggtttactgtatattgcttttactatgtttaggtatgggtcttgaacctttaacatgaaggggtgttgtaatttgtcaaaggccttttcagcatctaatgagatgatcctatgttttttttttccttagtatgtttatatagtgggttacattgataaatatccatatatattgaaccatctcttcatctctgggatgaagcctacatgatcatggtgaatgatgattttgatttgtttctagattggtttgtgagaattttattgagtagttttccatcaatatttagaagcaaaattaatctgaagttctttccttgttgggtctttgtgtggtttagttttcagtataactgtcacttcatagaacaaattaagaagagttccttctctttctacttggtagggtagtttgagaagtattggtattaggtcttctttgtaggtctgatagaatcatgcactaaaaccatctggccctgggcatttttttgttcagaggcttttaatgactgcttctatttacttaggagttatgttactgtttagtttaatctgtggatcaaggacctccacataaaatcagatactctgaatttagtagaaaagaaagtggaaaataacctcaaacacattggcacaggggaaattttcctgaagagaacatcaattgcttgggctctaagatcaacaattaacaaatggtttagaagttatctgcaggaatttttagggtcacttataaatactaccatatcatctgtaaatagtgatatttttacttcttcctttccaatttgtatccccttgatctctttttcttgtctaattgctctggttaggacttcaattactatagtgaataggtagggagagaatgagcaacattgtatagttcctgatttaaatggaattgcttcaagttactctccatttagtttgatggtggctactggtttactgtaaaatgcttttattatgtttaggtatgggccttgaaatcctgatctttcaaagacttttatcatgaagaggtgttggattttctcaaatgctttttcatcatctaatgagatgatcatgttttttttttccttttggttagtttatatagtgcattatgttgatatatttccatatgttgaaccatccctgtatccctgggatgaagcctacttgatcatgatgaatgatcattttgatgtgttcttggattcagtttgtgagaattttcttgaggatttttacatcaatgttcataagggaaattgatctgaagttctcttttctttgtttgatatttgtgtagtttgggtatcagagtaattgtggcttcatagaatgaactggatagagacaaatggtgctggttcaactggcggttatctccttgtacaaagctcaagtccaagtggatcaaggaactccacataaaaccagaggacactgaaacttacagatgagaaagtggggaagagactcaaacacatgcgcacaggggaaaaattcctgaacagaacaataatggcttctgctgtaagatcaacaattgacaagtgggacctcataaaattgcaaaacttctgtaaggcaaaagataatgccaataagacaaaaaggccaccagcagattaggaaaggatctttaccaatcctaaatcagatacgggactaatatccaatatatacaaaaaaactcaagaagctggactccagaaaattaaataaacctattaaaaatggggtacagagctaaacaaagaatcctcaactgaggaataccaaatggccgtgaaacacttgaaaaaaaaagttcaacatccttaatcatcagggaaatgcaaatcaaaacaaccctgagattctacctcataccagtcaaatggctaggatcaaaatttcaggtgacagcaaagatgtggagaaagaggaacactactgcattcctggtgggattgcaaactgatacaaccactctggaaatcagtctgggggttcctcagacaattggacatagtactatcagaagatccagcaattcctctcctgggcatataccgagaagatgttccaactggtaataaggacacatgctccactatgttcatagcagccttatttataatagccagaatctggaaagaacccagatgtttctcaacaaaggaatgaatacagaaaatgtggtacaattacacaatggaatactacacagctattaaaaacaatgaatttatgaaaattttcagcaaatggatggatctggaggatatcatcctgagtgagataacccagtcacaaaagaacacacacatgatatacactcattgataagtgaatattagcccagatgctcagagtacccaagataaaattcacaaaacacatgaaactcaagaagaaggaaaaccaaagtattttgatccttcttagaaggagtaataaaatacccatgaaaggagttacagagacaaagtgtgaagcagaaactgaaggatatcctccagagactgccccacctggggatccattccatatacaactaccaaacccaaacactaatgtggataccaacaagatcttgctgacaggagcctgatatagctgtctcttgagaggttgtgccagtgcctgacaaatacagaagtggatgctcacagtcatccattggatgtagcacagggtcaccaatgaaggagccagagagaagtacacaaggagctgacatagtttgtacccccttagaaggaacaacaatatgaactaaccagtacccccagagtttcctaggactaaatcaacaaccaaataaaacacatgttgggactcatggctctagctgcatatgtagcagaggatggcctagtcagttatcaatggtaggagaggcccttggtcctgtgaaggttctatgccgcactataggagaatgccagggccaggaagtggaagtgggtgagttggtgagcagggcaagtggggagcagatagtggggtttcagaaggggaaaccaggaaaggggataacatttgaaatgtaaataaagaaaatatctaataaaaattcagggagacttggaaaaaaattaattgacaagtgggacatcataaaacttaaaagtttctatacagcaaaggatactgtcaataggacaatatagcagcctacagatgggaaaagatcttaactaaccctacatctgacaaagggtttatatctactatatataaataactcaagaagttagactcaaaaaataaaacagaaaaaaaaacaagaaaacaaataaccccattataaaatgggctacagagctaaacaaagaattctcaactaatactgaatgtctgagaatcacctaaagaaatgttcaacacccttagtcatcaggaaaatgcaaataaaaatggccttgagattccactattcaacaatcagaatggctaagttgaaaaactcagaaaacatcagatgctggtgaggatgtggagaaagaggaacagtcctccattcctggtgcaaaagcaagctggtacaaccactttgagaattaatttggcgactccacagaatattgaaaatatttctacctgaagacccagctatactactactacccatatacccaaaagatactccaacatataacaagaacacatgcttcattatgttcatcgaagccttatttacaaaagccaggacttggaaagaacccagatgcccctcaatggaagaatggataaagaaaaagtggtaaaattcacaatgaaatactgctcagctactaaaacaacaacatgaatttttcaggcaaatggatggaactagaaaatatcatcctgagtgaggtgacccagttgaaaaagaacatacatggtatatactcactgatatgtggatattatcccaaaacctcagatttgcatgatacaactcacagaccatatgaaccttacaagatggaaggctaaagtgtggatgtttcaatcccacttagaagagggaacacaggaggcagagggaggtagggttctgggcaggatggcattagctgaaatactgaaaagtggggagatagaacctgaagagaccacctctagtagatagatagacatggctcccagttaagggatgagaccatccacccatgtcaaaacctttaacccagaattattcctgtctaaaggacgctcagaggggaaaaaaatggagcagagatgaaaggaaagggcatccagagagtgtcccatcttgggattcatcctgtctgcagacagacaccaaacccagacactattgctgatgccaagaagtacttgcagactcagaggacagcctggtatagctgtcctctgagaggttctgccagcatctgactaagacagaagcagatactcacagcgatccattgggcacagcaagggaaaccaatggaagagttagggaaaggactgaaggaactgaaggaggatggcaatcccataggaagaacaagaatatcacctaacaggactacctcagagcttccagggactaaaccaccatccaaagagtacaccagttggtccttagctctggctacacatgtagcacaggactgcctcatccggcatcagtagaagaggaggagcttggtcctgtggaggcttgctgccccagctaaaggggatgctagaggggtgagcaggagtgagtaggttgtgggagcaccctcttagaggcaaagggcaggggtatgaggtggaggagtgtttggaggggataccaggaagggggacaatatttgaaatgtaaataatttttaaaataatggtgtaaactctcagtttaaacatgtttatcccttcatggattgtgagtcacagcctacttgaaagatagtggatgtacataccaagctgtttataaggaagactggtatgtttgaatctctttgtgtcacttctgaatttcagtgctttgctactcaatgaaaactctaaagcagtctacgctgatatttgtaacagtctgaaaattacttaatatattttctaattaaaattcttctacttctgccatttttattagtactaatcattccagtgtcctgcaaattcccttggcacaatactgtggcttgtgttggactgtggttacagtcatgctagggttttaaaattcctcaaaatcatgtatgagttaaattaaaaaaaaaactttcaaaacacgattacatgtattagaagttggacttactataaaaatataggtgaatgaatatcttaattcagagtgtaatgtcacaaaaatctaacacttttctaaagaaccaatgcgtctttcttgggcaatgcttcttttcttaggttctagtgaatatttttacattcagacatcattgttaccaggaataaaggtttcctgtgggtattgatgaataattgccatactagtttaggtaagaagtactgtttaaacaacctgctcaaaatgaaccatcacttaatttcatatttcctatgtgtcatgtaaaaataacctcaggtgactatataagacacataaatgtggggtcttcactcatctgaatgttagtcatgcttaatatctgtattgagacactcattttcagtatttattgttgtgttaaaatagtgtgtcacattagcaatttgaatttcaaaagcattgacctgcaattcttttgaatgtttaaatataacctctgatccagtactctgagaaattgcattaaagtgatccctgaatttagagttgcaaggatgaatgaaaagttgacaattttccaaaatgatgacatttgccatctgttcctatgtctacattttaatggaaggtgaaactgaaaggcaaaagcttaaagttgaatgtgtgtcaagcaacattccagagaaagtgacaaaatgaagaaatagtaccatgtcccactgaaatgcaagcttgcaactgatttgcagttggtggtggtattgcttccttttccaatttggagaaaggtactcacaatctttatgaaaagcatttaagacaccatggcttgctgctaacgagtatgagcctaagggctgttagttgagtctctgacattttggcacattgttagctatcaggcaggccacaaactgtcaccattagtttccgaataatccactaccaaagaactttagaagtttcaaaccattagactctaacaaaaggttgcagattttcttatatgtccatggtattagcttaccaatgacattgtttaacaagcctttatgtacagataattcatatctatacctaaatatgagcagtgaagttttgtgtgtcacagagcacttatgattactcttaatataatgaacaaaaatcccctgcccttttgatttagtatgtacttttgaaagaacaacactgtatagtttcttgatccatgcctggcagatacagaggtgaatgttctcagtcaaccattgaactgagcacagggtctccaatggaggagctagagaaaggacccaaggagctgaaggggtttgcagccccatagggggaacaacaatatgaaccaaccagtacctccagagcttctttggactaaaccaccaatcaaagaaaacacatggtgggactcatggcactagctgcatatgtagcagaggatggccttgttgggcatcaatgggaggagaggcccttggtcctgtgaaggctgaaagacccagtgtaggggaatgccaggacagggaagtaggggtgggtgagttggtgagcagagggaggcaggaggggaaaagtcagttttcagagggaaaatgaagaaaggggataaccattgaagtgtaaataaagaaaatatctaataaaaatgtttttaaaaagaaagtacttcttattcagtttttccttatttttattttccataaaaagaatgaaagagagtaacagtttgtttctattgttacatgtatataaataagtattatttataagagaatacaaattccatggattccagaccttctcattgtaactcttcatttcaaaaagttgtgtccaattagcagtttcctatgtagagctgtccaatgtcccaagtggtggcatattatcaatgcatcctttttattcgacatgtaattccagaatccatttcaaaaatcataaatcatgagaagaaataatatatagtgatattgtggaaacttttccaaggtttgttcaatggagatatttttcaaaactgtgatacaatatcataatgaggataatgctattaaggcagttaagatatagaataacactaccagtgcaaagagctctcttctattctttcatagccatcttctctccctctccctctccctctctctctttctccatccctgcctctctctctgtaatatttcacccaatatgaaagccaccaaatattatataaccattttgaattgaaagtttcacttagaaaaactagtttgaagtaaatccaatttgttgtatttcttttatttctgaatagtcttccttagtatgcatacatctcagtgtttattagttaacttaatgatgtgatctggtctttttccaatgtgaggctgttaaagctaaaacgtctcctaacaggggagacccactcctacaatctcagcagaatggggattgtacatttagtattcagcctgggttttataaggaaaccctatctcaaaataacaaccaaactaaaacaaaacaaacaaaagacacagctttgtgaaataaaatttagttttacatttttattggcataagtatctaaaagtaaacatgattcttatgttataaacttaaaaatgaacctgtcaaactagtagtcttagttacttttctacttctatgaagagacaccatgaccaagacaacttaaaaaggaaagcatttcattggaaggttgcagtttcagagggttagtccatgatcatcatagtggagagtatgtaaacagatagccagggatggtgctaaaatggtagctgagagcttacattttatctgcaagttggagaaagagagagaagagcctgggcctaacctgagcttttgaaacctcaaggtccatttccagtgttacacctccctcagcaagaccatgtctcctaattattcttaaatagtgtcactccctgatggccaagcattcaaatacatgagctgagcctatgggggccattctcattcaaaccatcacattagctgacaatgtaactttactatgttcatactggcagtgcacaggtgacagagttcatcacttaattgaagtattttgtcattagagtcattctgaaaggcctcttgagacatcatattatgactttaatttccatttgtctaatacttaatgatggctaacatctttttgttctaattcaccacctctatcttttccattagattttctttttttttaattttttttaaatttctttttttaaattaggtatttatttcatttacatttccaatcccaaaagtcccccacacgccccccccccccgactctcccacccacccgttcccacttcttggccctggccttcccctgtactgaggcagataaagtttgtacgaccaatgggcctctctttccactgatggccaaccaggccatcttctgatacatatgcagctagagatatgagctctggagagtactgggtagttcatattgttgttccacctatagggttgcagatccctttagttccttgggtactttctctagctcctccattgggggcccattagattttctattaatgcacttgtctattattttgtaattcaattgcttatatcttattcactgggtctttacaaatctttgcatgtctagattccagttcatttaaagatatatcatttgaaagtactttctgctataccatagcttcattgtttataattttaatgtcttttgaaaaaccaagttcttagttttgatgatgctttttatgaaactttctacacatggataatacttttcatgtgaagtaaaagtttgtatatatatatatatatgttttaaatatatattgatttaaaaatgtatgatcattaaaataatgaatacaaacactttattgctacacatactgcatttaagactgattcattttaagtcaatgtttatgtacaatgtgagctcataatacaggggtttgacattatatgatagacttaacattctaacaaagtgaattctgctattttcttctttttgagaccattctctgaaaatatgttgcaagatcattatagctgtttaactattatatggtttattattttccattaaaattttagcatattcatgcctacaaaacttaaccctcttgactgtctttaattgcccctcactgggcaaccttgtctagcctgagtgtaagagaatgcacctagtcttgctgtgatttgatatggcaaagctttttaatctccataggaggccacaccttttctgaagagaaggggaggaagggtgagctgggggaggtgagatgacaggggagaactgggagaagaggagggagggaggctgcaatctggatgtaaagtgaataaataacttagacaataaaaattaaacctatcataaattgtatgtcaattttgtgaaccttattaattgatttgagaagatctcctgtcctaaggaggtagagtcctagatctattaatgtagtaagactttccatttatttaggtctttttctttggtttccttcatcagcattctgtcatttgcaatatgcagctattataaatatcttagtgtttggtacctaagtatttccattctctggagtattagtagaatatatttgtatttttacttcaatatttatatgttaaaatataggaatatgataactattttgataacaatttctaaaaacatgatttttctcagtcatttgtaatgtactctttacagtatctattttcttttccattgtcttgagtttctatttggagatcaaatgattcttatttggcattgattctacatattaaatatatatcaaaaatacttataaaaattcatttattcattcattcttataaaacaaatagctactaacaattttatgataataaagtgttaatgttaagatacaaagatattaaagttttgtccattcaagttgttggcaaaagataaagtatgtatgcaataacttgatatagatacgataaacaatagttgagaatattatatattttccctgcttatatctaaaacccctgggtctatcatgaataaagaacttaaggaatgtatgaaaaatggaaagaacatcttcaatgaaggagaaatgctgtattatttaccacacagcttggtatgttcgcattaatgcatgaattttcccctttatttaatttcttgagattaaatttttgtggttcattcaaatgatatatactgatttcctggagcaaatctattttatgttcttttattttctctctctctatctgtcccaaattgctcaaatcatttcagtgactaattgaagtttgaagacagtccattcatagcataataacttaaaacaaaatgtattgtacatttatactatttgcaatacagactgaacacaccttgctgggctttctgcaatagtacttgtggcagaacctccaccatatacaaactttcagtacgtttttactgtcttcagaggctattttatattccatataatgagccaagatgtacaaccatttataacatttgcttatctcatgcttactgatgccccctgagccaaatataaagctaacctgggagcatccttcacaagggcttacattcaataagagttcaaacgatttcaatgtctataaaataacagtgagctagaaacctgtcttttaaaaacattcatcctagttcttagataatttcctaagtcatattatggtattggagtaagtttataaatctatgatcacattttttatatcaggtcttgatgtcaccttgctctcatattctcaacaagcaatggtgacaaagcatagtataactaaaataaatagttctgcttgaaagagatggctatgatggaaaatactgaatggtcactgcccattgcaactgcatattccaaatggggtatgttactggttccttgataaggactattctgcttattagcagtggttcttagcagctctttgttctatctccttcctttccagaaaaaaaaaaatgaatgatgcacaggatcattttcaatctacaatttatctattcctcaaattgtaatttgtaatacttaaaatgctaggaaacattcaggcatcaaagcagaactcaatgtattaaatagataccacaaccagagaaatggcattccattttgatatggaagttacaatgcaaaaaaaaaaaaaaaaaaaaaaaaaaccccttaaacaaacatgtttagtctagctctttcagatttccacatggatcttcttaactatcttctattagtgaaggaaaatgtgctatatcccaaatatgttaacaactgacatatttgctcttcaaaaccaacttgaagtgtttttcaactatattcgggacatacttttttaaataaaataatggataggattaaaattctataaacgttggtgaaaacactactgtaggctaaattatattactttatgattctaataattactcatgaacaacataactcacaatcctcatttccttaattacagaagtccagttgaaaccacataatctagatcattgtaaaaataaaaataaaaataaaaatgaaagaacaagacataagtgaaagtctttaatgagtgatttcaagtttttagtggatgatatactgaaactgcagaactataaatcatgcattcttccacatcttttaaatgagaaactctctcatgtcataataggctttaatgagattttctggttcaataactctgataatgtttagagatgatagaaaagtgatagatcatcatagaacaatcactaagtttagctttcttcctacaaacatgaagtatttttgaaaagtttgaattatttgggaacaggacaataattatccaaaatactatttttctacccattttcctctttcaaagaatatatccagttgctaggaattaaacctaaaatggatgcgaattgcttatttcatttaaagatttttaccattcaagaaattcatgtttttagcatcatagcttgttttattttaacttggagcatgaaattaattgtattgtacagatatgaggataggttcttaagacactggatattagaaaaacatttcctaatatttcaatatactaggagagataaaaagctgttaagttatgatttaatatttaggagacagacgcatttttaaagaaagttcaaaattagtatatatttactagaccagtcattaatataattttattattaacaaatataacagaaaagctttaatatcacataactgataactgaggaaattctaatttaattattacattcattcactcatttacctattgcagttctgaagatctatctcaagactcaagcatgataagcaagctatttacattgcatctttacatctctggttaaacatacctgacaaataaagatctaaacaaagaaatatcctttgaacaatatttacagtttgccaattaaagacaaatttgaatacaaatagaaatataaataaaatttgtgtgaacaagggatggataggctgtgcagcagttaagagaatttggacaaatgggtttatctggaggatatcatccttagtgaggtatcccaatcacaaaagaagtcattagatatgcactcactgataagtggttattagcccagaaacttagaagacccaagatacaattttgcaaacacaaagaaaatcaagaaaagggaagaccagcgagtgcatacttcattcctccttagaatagggaacaaaatacccatggaaggagttacagagacaaagtttggagctaagacgaaaggatggaccatccagagactaccccacccggggatccatcacataatcagccaccaaacccagacactattgcatatgccagcaagattttgttgaagggaccctggtatagctgtctcatatgaggttatgccattgcctggcatatacagaagtggatgctcacagtcatctataagatggaacacagggcccccaatggagaagctagagaaagcacccaaggagctgaaggggtctgcaaccctataggtggaacaacaatatgaactaaccagtacttccggagctcgtgtctctatctgcatatgtagcagaagatggcctagtcggcaatcactgggaagagaggccccttggtattgcaaactttatatgcctcagtaccggggaatgccagggacaagaagtgggagtgggtgggtagggaagcagggcaggaggagggtataggggtctttcaggatagcatttgaaaggtaaataaagaaaatatctaattaaaaaaaaagagagaatttgctgttcttgcaatgattccacgtttgatccctactacccacatagttgctaagaactgcctgtaattccagatccaggggactagaatcactctctggcctctacagtcactacaatgatacatattgacccacacctaaacacacacaggcacacacgtacacacacatacacacgtacacgtaccacacacacacacacacacacacacacacacacacacacacacacacacatatatatatatatataattaaaaataaaaataaaaagtaaggaactggagagacgtctcagaagaacatctgctgcccttttactgaaaagtccagctcaagcacccacatggcagcccacaaccatttactccatttccaagtatctgatactgcctgcttctgccaaaaccaggcatgcatacacacgtgcaaccaaaacagggatacaaataaaatgaaataaatctttttccattaaaaaatataaaacagaatagtctgaagagaagaactttgcttctctaggtaatatcaaacataagcatttcagagcttacacttatgggccagcaattgtttctcactctaggttttgcttccagttttattttcaaatatgaaagttggcaaccatatctatgattcttagcctggaaagtgtagaataaaaggaacaaagaacatgatctttcctgccttccagaacaagtcccaaatgtttccttggttgtttttatttctagctgctaggctagaacttgttcgcacaatcccacctagctgcagtgcagactgagtaggcacatgcaagacaaagcttcagagaaaggagcaggtcaaagatgtgttttcaaaagtctagctttaggcaacagagcatatgctgggttgaagactttgtactgccctgagaaacaggtgtttggagtacccaagcatctctgtccaagtgacttctgtcatactaagttgatcatttaaaaactttacctgattagcccatgttcccagtaggtggaggatgaaaacaacagttggtaaaattttgtgagttataaaaacatcttctacactgtaaaaagaaaaagggtagtaatattgaggggcgttcatacctattttgtagcagacaaaacttattcctctattcgtataaagataacttcatattatatttccattgttaaatgataaccactccattaatgcttgttaagctatgcatttgtttacacaattttctactttttcaaaatctatcataatcttccttctttacaaaatttgtaaagtatataaatataagtattatcaggccaacatatctacccctagcatctcccttcaatggatatcctcaatactggtacatattacacttacagccaagtaggagaacttcaattacattcctgaattatctagcttagtccaggttctttcagtcatctttaattctggcttttctcattgacgtggaagtaaatagctacctgggattcaatgattaggacacatacaaattcattatgttcaccttctataaaatcccagattaagagccactatgattttttttcatatcagtttgctatggcctagattgattgtacaattacaataaaatttcttgctttcatgcagatctccatttattaactgctccatggtgcagaatctgtggttataaaataaaaatataataaataaaaataacaaacgaaacttaaagtgttcacagagtaagaatttaactgatttaataatctctcacaattatagatctgaaattatctatttgctccaagaaggtcataaatatcattctcataaaagagtcaggttatgagtgcatgagtaatgtttgaaggctagtctactgacttcaggcaatagcatgtattgttctaagcctctaaaagcatcatgtcagtgcaatattacatcaaaatgaataatcatgtttgagaaaaatagcttaagtaagatattttactctctctagaaaagcaactgcagtataggtattcatggatttttataataacttcaaggtgttacatgggttaaacaccaaggccactttctgtatgtggctccatttccaaggttactctaggatcatagtgctcctagagcgcaggattgttaatggcatttaacttaaaataggcacacttagactttataagaaaaatatttcttttattatttgtgtgtgcatgtgcataggtctgtgcaaatgtgtgtgtctgtctatatattcacgcatgtggatactagaataggacatttctccattaagctggaattataggcagttgtgagcttaactgcatggatattgggagctgagtctttgtagactgcggcaagaattcttaacttctgatctctccagtacctataaatggaccttattatttggtttgaaatggtcattacatgatttccacaccattcttatccatgtgtcagaacagacacttttctcagtggttcttatttagcctagaatcatataatgtagacttggagagaccttttttatttcagtgtaaaaattgtatcatttttcagcttaatgttcacaaaggttatccagagaaactaaacagagcactcctgaaactagcaaatagaagtacagaaaatcaaggtagatttttattcagaaatcaaaagcgactcaaaattattttaaaatgtgttataattgattttcttccaataattcaagcagatgtccctctatctgtttcaatgaattgagattttctttaatccaaatatcatttcacttttgatggcatttttagtagaaaaatggttacgataatatggcaacaaaattttgctctatgtataaataccaaggcttaattttgtcttcctgggtattgtcttgaacacaatctattaaatgatagacttgcagttacgttgtactaataatattaacagaaaatagcatattttatgtcagaagttctagcattagttactcacaaattgatataatagactcacaaaggaataccttttatattgtgtccataaaatgcatggaattgattcataaacaactctatattagattctagaagctgctggaagcagagttaagtgaattcagccaaacagaatgaactctaatacccagaactctattctcaaaaacaatgtttgagctagtaacacctcatgcccaggtatttagtaagaaaatgaacagggtgccttcagatgagctatcaagctgacccaatccacgtgatgtataattttactcgaaaagcctcactcttcatttgcaatccaagtacttctggggctttagaaagattttcaagttgcttttatttttttaaaccagaatactttaaaggaatttcatctctaaaacttcaacttccatttatacttctgcctaaaatttcccagtgattcatactagcacctcctccacttcacaaaagaaaggtacccctctcttccttccctagccatcttaaaatgcattgctccagggtggaagaagacttgcatgatagacaaatgtatattatgaaatataatttaaaacatcaaggaattttgaatgaagaaatcgtcttctgcctgcttgtcttaaatgaattttagttaaatgtgaagcttattctgagttagtatattcctaactcagaaagccaaaatgatagggccacaatactgaatcatttgaatataattggaatgcattataggacaatcagtttttcaaaattctcttgataaaatccagtgataaattttattttttgtatatttgtttttcattatcaaaacctccctcaaaacttatttaatatacttatggcatgaattatttattttatttactcaattctcattctattccattttgtataacatgcaatgctttgttagataaagtttactaattgagagaaaacatcatactgtttataaaattttggtcaggtacaatttttttttaaaaagaaattgcatagggaatagtttctaaacaaacaaaaagctctctacttcctttcaatatccactgaagaaatggagaattttcagtttgattgttcaacatgcatacatgtaactcttttctatattaagtttaattttttacatttattttaattgcgtatgtaaaatttgtccaaaagtggcagtttttaactgtgttgtgtttcatgcattctaagtgagtgcacaataataagcactgcagacagagtctcttgatggttagcatccagcacctaccatagtgctcatcatattgtagaggctgatgcttgagattaaatgttcctgtaatcccagtccttggaaaatagaagccggagaaatgggatttcaaggacaaactgaagtacataatgaaatcctgtctcaaaaacaaaaacaaaaacaaatggggttcaacagttaagggtacttactgctcttccagaagatctgagttcaatacctagtattcacatcagacagttcacaactaccagtaactccacctccaggagagccaatcaaattcttatagaatcaccaggcactgcagtcatgtggcatatattcagcatacacaaagtaaaaataaaatattaaagccaaagtgatacttgaaaatctatataaaggtacatatctctcaaaatatcagaatgttagctataaatgatgcctctcccttctaacctgctacatatgtgttctctagtaagtggtgttttgatagttattttttccttttccaaaacgaggtacatcttcagctaaatttaatttagaggtagacttacaggtaacaaagttgcagcagggagccttctggattgcactgctgtgatcttgaaatgaatgagtagtaaagattagtcaacctgctgaaaagttcttaattaagaaagccagttatgtgcaatatagcagcctgtgtgttagccttgttgacatcgtacaaaaagctcatgtagatagcattcacaaaagaataaaaatgctcttctagtcactcaactggaattttcagtaatcgtatttctaaacaaaattgctcctatgaatgtctgctcaaaggctttgacttataaagtaatggtttgaaattatcaaactttcttgatctctgaatgttgttttcattaattaggtgaatatgacagctctctctttacactaatagcccccctggaggaaataacattttttgtttgtctaaacagtacttaatgactactctaaaattaacattggagacctttaactctagagtgtaaagcagtatgtccttgactctgatgttcaccatgaatattaattcctggtcttaaagtggagccatgaaaattttatttattgtcatgtgtttcccttggtagtttttgtaattgggataatttcttcatcaacaagagctgattgtgctttccttggctaaagaaatgtatgacaatttatagctccgaatgctgtctttacttccaagtgaagatacagacttgtttactctgagcagtaactagacttctgaacttaaaagaatgatcgtttttattgctgaccttacatgataaaggactcaatatatttttgtcactacagactttcactctcacctctgggattactttcctattaagggagatttatgcctgctgcttcagacactttctctgtagctcactaaaaatgttacctgtagatatgatatcctatcatttttttcaaaatttactaattgctattgtcttatcatcaaatatcaatatataagcatattcatttatgtagatagataatagattattcaaacagtttgccattaaaatagtttagatcatttacatgtggatttaaatattatgaacacataaaattatatatatgtataaatgtacatatataatttagatgaaacagttttctgttagtaatttagcaattttgatacacattcatcaaatacctactaaatgtgaggcttgaattttgttctgaaaaggaaagaaaactggtctggacacaaaatgactccaagatgctcaagatgatagaaaggctcataaacaaaaaaacatttctgcatcacaggatagcaaatggtgttggatatatggtaacaaagtactattccaagcattggggctcatgatagatacacagagtatgaaggaggtactgtggctgagtaaaattgattttcattgatagagaactggggatgatacttagttttacatagtagaagtgactcactgtcagacatggtggattggaaaaagggatttgagaatgtaggaacatcagctatatgtaactgaaattaagactaggaggaagtatcgtaaacaagctaaaaataaactgtaattaggagtggcttgtaatctagcctatcctgatgctagtccttgacattatagtgagtcattcctttctttgtggaggatagtaaggatgacgatgaggtttggtcagaagagatgattcataaaccagaatccaaagctctcttttaatgaagtacaatgagatccttgaagcatggttagcttataactaggatccacaacaaaagaaagtgcctcaatgcctacttcataaacacaaaatatgaggaaataaataagcacatctgggaagcaataaacaccatgtacagccaggacttatcaagaaaagaccatgaagagatggagatgctgaggatttggagtagacacatggttacagaaacagggtattaagctatcccatgaataagttagagatgaaggatctatgtggacatggaattataattagtaagtgaatggagaaatcagattgtctgaaggtacaaatgcaataaagtgtgttctgaagcaaggaatcctagaaattttggcattgttatgtaaaactaggaaggtcgggcttcatgaacttactaacacgctctttaagaacatgctgtgcttatctatggtgatatttgaatgactaaatgaaaaagcatttttttttctgttaggtggatggtaaccagatctttagaggtccaattttcatttcttactctttagtgcaatctcattaatctcacctgtctaattgcttataattcagctgtcagacattttattgtatttcatattacttagaaagtgatacttatgaaatataaatctgcttctgtatcatctataggatggaacgcagggcccccaatggaggagctagagaaagtacccaaggagctaaaggggtctgcaaccctataggtggaacaacaatatgaactaaccagtacccccagagctcgtgtctctagctgcatatgcatcagaagatggcctagtcagccatcagtgggaagagagaccccttggacttgcaaactttatatgctccagtacaggggaacgccagggccaagaagtgggagtgggtaggtaggggagcagggcagggggtgggtatagggaactttcaggatagcatttgaaatgtaaataaagaaaatatctagtaaaataaaagaaatataaatctgaatgtgttatttcccatttaaaaatcctccaatgatccctcaggctttcagtggaatatctcaaatatgctaaggtataaatgccatccgtgacagtcaactttgcaattgtacaataaaacacttgaagaaatcaaattataaagataaagcattacttggcttacctcattctcagttaaccagaacttatcctcaccacttaattgacagaaacttagcacaatggtggaaaatgcatgttgaaacaaacaactaacagtaaggagatgagagaagagagaatatttcagagtccattgttttcagttagtataccaccaaatggcctaaggacctgcccctagatctcatttacttaatattccattacatcccaaaactgcttactctgggaatcaagctgtttgagactttgaggatcactacatgatacatgaaactcatcatttatccatgttttctttatatctcataatattttattgattattatacaaaagccatctgagagaactcttatatatgcctcctattgacatttctcagttatctcaaggtatttcgtatgtttcattcaatagaagaagccaaaataatacgaaaaaaatcaatgtaagtaccaataaactatgatacaatatttctttccacaataattttagatgacattcctaattacataaacagtaaacatgaaaaattatacctcagcattaatagagtatatgagttgcaaagatggttcaaggagtgcttgctggctgctgttacagaggctctaagttcagcttccaacacccagcttaggtgcctcacatgagctctgtcacttcagatcgagagaatttgacacctctctcttgcctctacagaaaactgcagaggcacacatgcatatacatgaatccaaaatgaaacatttttaatgatttgagatgttgagaaattcataggaaagacaattaaccatacaattaactacatcctattataattttttttccagaacaaacttttggggaaaaaataaaattcaatgtaacttcttgtccagtatttgacaatgtgtttctgaaatcttaagggtgctaattgagttaattcaaaacaacattaagaatacatgatgagaagtattatcctggggtgtgtaaaatgatataatacttctaaaacattgttaagtcccaagttatttgtaggaaagaatggaaatcaagcgtcttttagaagaaaaagagaacacaaaagtttactcttaagaattccttatacaacattaagtaatttttacctaactttaaagatttgctacagctcactcctggtcaaagtgatacctcaccagactcctttaagacagcatagaagacctttgcagtaacgaacaatagtactgcagtaaaggttaaagagtaaactcattcattgaaatatagacattagaaatttcaagcatttgaatgagctactaggaaagtactggaagaaattagggtgaaatcaaggtgactggtccgtttgcaatgctaattggtctttatagaagtcaagctcttactccctattggattgggacacagggacattatctttctaatcactaaagtttaaagggaccattcaagtgctttagaaagttattcctggttttaaaatattaataatgccaagtgagtgttttaaaaaaggaagtgagaaaactaggcaagtttaacccaactaagaaattatgaaggccaattggaataacacaaatcattctcaaattggggggtcaacgttacctttggatgctctctaattatttcacgagtctgttatactatatttatatgaaaatcatggttttgtggttttgaaaattgtgtcatgacagtttttctacaataatatcacaatcaaaatttaaaagctgaaactaggaaacaaaataaagtaatggaagacatattaaaatacaaatttgaaaattccaagaacaatcgtttctgaaatctgactaatgacataatacaaagaaggttaatggggtaagaagatggattaatggaaatagctgttttgggaatatgaacattaacataatggaaagcaaaaaataaaaggcctatagtaatattaactatttttgcactattttaaaagaggccttcaattaaaaaatacaccaaaacaaaaaaaaaggaaaccatcagaagaaagctatgttaacattataatcaagtccagaagagtcagagaataaacacttcagcaggagctcttaactaactcctgatcctcacttaaattaaatgtttgatttatttttgcttttgcttgttttaacaactctaagttaggaaaattatattctgggatgtatgaattaagagtaaatttgtgttcttgtacatttcaaataactttttttaatctctgaaattcattttttattagatattttctttatttacttttcaaatatcatcccctttcctagttttcccttcaaaacctccatccccttccgacttgccttgctcaccaacccaaccactcctgcttcctggccctgccatttccctataatggggcctagaaccttcacaggatcaagggcctctcctcccactgatgacagactaggccatcctctgctacatatgcagctagagccatgagtcctaccatgcccccccccctttggttggtggtttagtcccagggagctctaggggtactgcttagttcatattgttgttcctcctatggagttgcacaccccttcagttccttcggtactttctctagggacctctagaatgctgggattaaagagattgtgattaaatattttaattttaacttgaatctagattcaaattgctagcgatttggaggacaaaggctggagacccagattctagctgttaacttagtagattgaatcttttaagttctttgattgaagtaaaatctgagtctatggctttttcactgaaacaattgcaaggaatatacagcaacttaaaagttgaggttaaaatattttaatataatataatataatataataatataatataatataatataatataatttaatataataaattaaaagttgaggttaaaaatattttaatataacttgaagcatgaaaattaaatgttagaaaaacattaaagaagacacacccaggggcaaagatatgggtatctctaaaagagactaaagcatctcattgcctttataactgtcgtacaaacaattttagtgtgtttgacatagctatcttcaaagggttgttaataaatcaaaatgagatcactacttggttcctgaggaagcacctaaatagattacaattaataaggtaaaagtttagctcacagggatacagaaattgtagatatttgtactgtaaacacgtttgtttgggattttcaagcaatgtgtagataaagggaggagatcctactcaacgccctagacacccaggccttaagcatgcttcattattactttaacatgaaattttgatgtatgaaaggactttcagctctttgccagcagccttaatagcaaatgctttttccaatcaatactggaattcttgcgtctcagatagtgagaactttcaggcttctctctcttatgtctcccacattttccctgtctttctaccctgcctcaagacttaagtgaaacttctgtaacaacaacagaaatatttatcttgagctattcaaatgcttccaggcatttccatttactgaagtttataacagtcattttccttgatattactttttttttccattgtctaagaaactaaactgaaaaatctaatctccatttcctaaattactacttttcccccaatgaaaaatttaagactacctaaatgattagagtataatggaatatggcaaattgccttctacagggatgcttcacaattaaatattgccaaaaatggagatcaaagtagcatactgtattttcttttaagctaacacatagaagatgttacataactatatttgcttttattactttgatctcataattattcttaccaaatgagtaatagaaaagatttctgtacaaaataggtacacaatgaattaacattaggcctggagagcaaccacctgctttatttccactttaagggaggttaacatgatctgagcaataaaggatgaggtaaagttgcattataaatcatagtatacaaatacacctatatggaacactaactctaccagcaactttccaaagactgtgttctgaaaattactctctttagattaatgctatccaaaggaaatctatatgtgatttaataactattctatgtatccattgttcagaataccaaccaataaacatatactcccttaagcaattaagatgtgcctagaataacaaagattgaagacttagttttcatagaaactgatataatacttatagctacaatacactggacaaacatttctagattctctagattcttttcatgtgcaacaacattatgaactaaccagtaccccggagctcttgactctagctgcatatgtatcaaaagatgatctagtcggccatcactggaaagagaggcccattggacacgcaaactttatatgctccagtacaggggaatgccagggccaaaaaatgggaatgggtgggtagggaagtgggggggtgtatgggggacttttgggatagcattccaaatgtaattgaggaaaatacataataataaaaaatattttttaaaaagttgaataatataacaacaaaaaagaaagaaactatatctgaaaatatattaataaaaaatatctatattgcttgaacaagcattttccaaattaattgataatgaaattcctttttaggaggtcaagaaagatagctcagttgtaaagaacacttgatactcttgcaaaggacccaggttcaattcccaccatatttatatggccgctcacaatcatctatatcttcagttccaaggaattggactccttctggactctgagagcactgtacacatggggtacacacatgcatacctataagaaaaatattcatatacataaaataaaaaacaatattttaaaaattcctttttacatattaataatagagtactgcattcttttaacgttttgtaagaataatgaaagttaaataggttaagcttccttttccgcattattcctatttgttgatttactcattattactcaataagctaatactgaacttgatactcagcatcctttactaagagttattggtatgtccaggaaagttaagatagctcctgaagtctgctaaattccaagaaacatgagtactatgggaatacagaagaagcaacataatcaagatttgtcacagggaatcctcctagggggaaacataaagacaagtgaaccactgtctagccagactcccttctcattcacagtgagacaagtttttttcactttcttatgggtttctcccttataatctgtaatcaaatatattatctgaattttgcatgtctctttcacaatacagtcttgcatcctcaacattgtctacattcttgttcactgtctcttcaagcccattcatactacaaaatacctcatgaaagaggtcattcttacactaagctattattgcacttcatagtcaagtcattaaaatgcaatgtataagcattaattacccagatgcttaggtattttttctgtatacaatatagtactctaaaatgaaacaaattatatatatatatatatatatatatatatatatatgtgtgtgtgtgtgtgtgtgtgtgtgtgtgtgtatacatatatatatatacatatatatattatatatatgggggtgggggtgtatacatgcaggcacatatacatatacacatctatgctcatgtattctctattttatcctaacattaaaaacggtccacattatttcactatactctctctttttttgctataatccactttcaacaaaataaggacgggctacatataataaaatataaatcctctcaaaccctttctcaggtagaactagagttcctttcaatccttaagagaaaaaaattctcattttatgattacttaaattctcctatagggtctactccaactttgttcttctaacctaagatttaagtttctataatgattttgcagataataaaattctaaagtgttcgacattaatttataagatatttcttctccagctgtgaaactttttttgaaaatgacaaactgtaagattattgcagtggtgacttgtatggtgacctcacagaaggaaaacgaatcttaaaactcttcctaaaacattcccgttgctgacagtaaactcctctctaatcctgtccttgaccttcattttatttcaagcttcaaaatatgacagttctttctctttgtcaaaatatcacttttgcatggttaaacgaaaatgtaaagcaatactgcagaattacttttctccaaaaaaaagaaaaatgtgttagcaaacaattctataaaattaaagattcaaataatgtaatcttattacactaatggaattttattaaatttgttttctttactcaatgcaggataattatcaaaaatccagatgttaatatacatttctgactgaaatagaatgacatcgatgtcaaatgttaccttccttaaatagacttgcttgtagagtgctgaccaagcacagctctatttcctaagtagtataataaagacacaaattcttaacagaatcttggccacttctcaaaaaacacagtctgaaagcagatatttatgtagtcatggatttgtgttcaaatgattaaaagcaggccttcgaacacaaatatccaattagaatcagtcaatatccaaaatataccacagagcaaaattagtggagtcagtgtgtcctggatttagtagttgtataactgaatgggttcatcagtttgtttaatctgctgaccagaaaagtggtcttaacttcagagaagcacattattgttttaacttgtatgacttttaagcaagtgaatcctttataacatccattcttctacttagagattcttcttcatcccagtggccttcaaagcctgatctttttttttttttttcagaaaagaacactatttttttttaagttggagctgttttattatgcatattccagacaaaggtcgtcttaatttattttctattgctctaaagagacaccatggccaaggcaatttatagaagagtttattgaggacttgctaaattgtcagagggctaggctataatcatagtggcaggaagtctgtcaacatgcaagcagtaactgatagattctatctaattttcaaacatgaaatagaaagagggaaagatcaggactggcttaggatttttgaaacctcgaagctcacctcaagtgacacatttcctcctacaaagccacacctaataacccctccaaaaatatttccatcacttggggaccaaacattcaaatatatgagtatatttgaatgtttgggcgggtgtgcttctcattcaaaccaccaaaaacatattttccaaaattcctcaaaatccccaatgaagccctgtagatatttacaacatcatttaatggagaatggtttcctaaaacaaatagtggaatcttattgatttaagaacttttaaaattaagtggttttgttgatatgagttaactcagttgcaacatggcagtacttgtaacattatcttctttggagtgtttcgaaaatccagtaaaataatgcatcctttacagcatacctgtaatttagttcttaaagtgttaagtattttttcactgggcatttatttcatttacatttccaatgctatcccaaaaatcccccacatgctcccccacccactcccctacccacccactcccaatttttggccctggctttcccgtgtactggggcatataaagtttgcatgaccaatgggcctctctttccagtgatggccgactaggccatcttttgatacatatgcagctagagtcaagagctccggggtactggttagttcatcataatgttgtatgcaccaacttatcaatgccgttactgttattattcatttacttattgcaaaatttccacccaaatacatgttgtaaagtaggagcacagaagtaagagagctaggcactgaataaataagtagactaaaaaggttcattactctggaacacagtcagggctctggagaaatagaattgatatactcaggcggcagcagatctaaaattatctgcacacttgtctttgtgaatctgatgttgatgcaggcccttgatggataagctgtgctcctccatgagcctgccaaggatcagattactccaggttgctggggggtggaggtgggggtgggggtaagtatgtaaagaggctttaaattattcattcccacctatactggctgggtttgtgtgtcaacttgatataagctagagttatcacagagaaaggagcctcactttaggaaatgcttacatgagattcagctataaggcatttactcaattagtgactaagggtgggagggcccattgtgggtggtgccatccctgggctggtagtcttgggttctataagaaagcaaacagagcaagtcaggaaaagcaagccagtaagtaacatccctccatggcctctgcatcagctcctgcttcctgacctgcttgagttccaatcctgacttcctttggtgatgaacagcaatgtggaagtataagttgaataaacccttttctccccaacttgcttcttggtcacgatgttttgtgcaggaataaaagcctgcttaagacaaattggtaccagcatagtggggtattcctgtgacaacctgaccatattttggggaggactgtgaaaggactttagaactttgggataaaagagccattgggtgttaagagctctgtgggatgttctatagtagcttggaagataatgttgagaacagtgcaaacagtggaggcctggtttttgaaattttggagggaagattaaagactcttttatcagggccattgctgttttgattgtggtcattctgtaattttggttagctggggctgaagaatcgtctgtgattaacaagatgcaagaactacaaaagtgaaaccattgtattactggaactattgatgctggctagctggaactaagaaattagtggtgattaagataccagcatcattgaggtgaagtcttctggaaagtgttttctgagagcacaaagagactgtttcagagatatccaaggttgttcctcatgctgcacctggacttggtaatgtgtaggagttacccaggtgatactgattttgaagacaggaagggatcatgaagatcagctgaggcttagcactgtaagaagccatagaaggtcattgatgtaggtgcagcctcagttgcaattgatggctcaggattgaagggttcatgcaaaagatttgaggcttggcaccatgaagagagcttatgagaggctattggtgaagcctagtttcaggggaatacagcagtgttttggagatgccagtaccatgatataaccaccaagagtagcagccgcagcagtagagtacaggcagctggagcctagaagacaaggtgtgtgctacaaagggcagagctggaaaagtgacccaagtccttggaggagcccagaaagtcttgagtggataccagacattggacagttagtttgatttttgcttttgattgtgattgtgccctgatagttttccttcttgacataagaaagtattttagtggggtccacagttaagagactttgtattgtaaaaagactttgaattttaaaaagatattggatattttaaaaggattgaattttttcatatagcattttttattctttaatctttttttacagtcctttctttatcccccttccagtctaccctctgactattccgcatcccatatctcctctccccatctccaagaggatgtccccacaccccactcctaccccaccaggcctccccactcccaaggaccacaagtcttttgatggttaggtttatcttctctcactgagtgagcagaggacttggcattcctctgctgtacatgtgttgggggggtctcacatcagctggtgaatgctgcctggttggtggctctgtgtcagagcaatctctggggtccaggttagttgagacggctgtttttcctatagggtcaccctcctcttcagcttttccctaattcaaccacaggtgtcaccggcttctttctgttgggtttaaatatctgcatctgactcttttagcggctcagacttggaggtcagacttgctaggctcctatttgtaagtacaccatagtatcaataatagtgtcaggccttggggcctcccccattggcctgggatgttgcacccgctcaactggccaggaagaaggacgctacaacaggatccttctgcacacgtttattcagtcctgtttcttctttctctatatctcccttgtttatatctctcccgaaccctggacctctcactcttttatactctcagttcccatccacgcacagcaggccatgccacctcaccaggcacgcagcttcagctaatcagggcagcaggggcatatctccatcaaaatgcattcacgggtatcctggtactcctgcgcagctctcaagatgtttgtggcttatatgaggaagtcaggtgcaagtcatatgacttagctgcagtccctggcgcctttgggactgccgccacacccgctcctcacactgggaggtgagagactctcaaaactcaaagggagtgaccttagatgaaattctctgcagcggggagtagaaacttatagagtccacctccagtagaaagacagggcattaagtggagggatggggttgccagcccatagtcaaaaagtctgacacagaattgttcctgtctgaaagaactgcagggtcaaaaatggagaagagcctgagggaaaggaggtccagtgacaggtgcgaattgggatccagctcatagattgaaatttgtatagggaactttcaggatagcatttgaaatgtatataaagataatatctaataaaaataaataaataaatgaaaaagaatttgtaaacactgtggcaattttaaaatttagatcttagggatgaatacaaaagtaagggttgaggcttaatagtgatatatttgtgtgacaagttgacaaggggtcaattgtactggcttgctttgtgtgtcaacttgataacaagctaagagttatcacaaagaaaggagcctcacttgagggaatgcctgcatgagatccagctataaggcatttcctcaattagtgatcaaggatgggagggcccattgtgggtggtgccatccctgggcttgtagaaagcaagtcaagcaagccagtaaggaacatccctccatggcctctgaatcatctcctgcttcctgacctgcttgagtttcagtcctgacttccttggtgatgaacatcaacatggaagtgtaagctgaataaccccttcctacccaacttgcttcattgtcaggttttgtacaggaatagaaactaagaaaccacccaagtaacagataatgatcaaatagtgtaattctatgtaaatagttggctatgaagtagatgaatcaagatatgagaattataattaaaaatcagaattcaatataaagtaaccaaaaataattttcaaatatatgtaccttggaggaataaagtgtctccagataaggagcatgagtttttatcttataaagtataatggatttctttattactaaaattaaaggaatataaaattattcacatcctacccaaatctctcaaaaaacttatttgatttatctgatataggtaaatctataattataaatattgcattgttttgttatttaaaattgtaacaatattaatgcatacacatgatgcaaagcttattgcaataaataatcactacacaagaccagtattcagaaaaggtcaatataagtcatttattgaaagtttttaaagatgtagtgcatgattctgaaaacaatgagtttaaaatgactgtagtattaagccaggcgtggtggcacatgcctttaatcccagcacttgggaggcagagacaggaaaatttctgagttcgaggccagcctggtctacagagtgagttccaggacagccagggctacacagagaaaccctgtctcaaaaacaaaaaacaacaaaacaaaaaacaaaaaacaaacaaacaaaaaaacaacaacaaaaaaaacaaaaaaaaacaaaaaaaaaacccaaaccaaaccaaaacaacaacaacaacaacaacaaagaaaacaaaaataaaaatgactgtagtattattgagaatgagggtaacttgagtcctcagtcactcattgcgactttgtttctattgagagatgaaaggagactccacaaagttcctgtgagattagagttataagcaaaggtcagtgcaatgtgtgagaaaagattaactcaaaagataaaagtagatggcaagatgagctaaaattaaaatatcggaataaagatgaaagtgagaactcaaaagaacagaggaggcaagggcagtcatggtagatatagaggagataaagatatcaaatttgaaagcttagagagtaaggagtattgaaagaaatcatgaccgtgacctgagccattatttatcttctttcccccaggaacaactttgtggtctctgaagaccccacctctgaaaatcattgatggtttgttctctctcccctgtgaatgtaaagtcaatacccttaagctattccatgacctcttactcagttccaaaacagtatctcttctcttcagagtagattttttttttttcagagtagacagggtgtcttagaagaacacataataccaatgtttctgaacaaactgttttaacaaccatttttgtaatttccctgctgcattgttatccagggtcatggtcacattatgaaaaaaattaatgtccagaaaagactctaaaagtatgtactttaatttgtgatattgaattataaatgtggaaacataaccagagattttgggctgaaaattgaattgactcctatggaatcaaataattccatgagtcctctaaatgcccccaaatacttaagcattttatgtcatggataccagcttttcacaggttggaagaaaatttccaggaagtatacaaaatgactatcagagccattaatggcaaaaatgaaacaaagctgattttctttttattttcactcattaaaggttaaacaacttgttttcctatatttcaccaaggaaattcaccattgatggtgtttcttgtgatttaattttcagtaacaaagatttccaaataggttttcctttgaaaatatttttttagatattatggcttgttttggatagcatataattctgcatggtagaacagtaatatttggtagagttgtaacatcaattcattctgaaatggataatttaagagtcttcatgatttgcacagaagttttgcttctggtttcatattccgtatttctaaggaacaagtagtaaaatgtaagtagaaaagcatgtgctggtaccttcaataaaatggcttctgggaagatagagcagttgtatattcttagcaacattcatgtttgtggacttccccttgtggtcattctaaattctttcaataataatgatgtcatttccttttgcatgaactgtatttctttccttttaattagttctcacattctcttggttttgttttctcattaatcctgaaagttaccaataatatatgtggtattttattttatattaaatgtatttatttactcacatttcaacccaatatgagccctcactttcctcccaatatcccatcattcaagtcttccccccattccaccttcctcttctcttttgagaaatgcaaacatcctctggttattaaccgccaccccccaaaacacgcacacacctcacatcaagtctctgcaagaataggcatgtcctctctcccactgaggccagaaaagtcagtccattcaggggcacaggatcaataggcaaggaataggctcagggatggcccacttcagttgttagggaacctgcatgaagaaaaagctgcacatctgctacatatatagagggggactaggtccagcccatgcttgctctttagtttacaattcagtctctgggagaccccaggggtctactttagttaactctgctggtcttcttttgcagtctctgtcctctttgaattcctcaatctttcacccaactccttaagactccccaagttccatctaatgtttgggtgtgagtctccgaatctctttctattgactgcagggtaaagcctctcagaagacagttatgctaggttcctgtctgaaagcataacagagtaaatagtgtcaggaaatgtttcttgctagtggaatcagtctcaatatggggcagtcactggttgagcattacctcagtctctatctttgtccctgcacttcttgtaggcaggacatatttgggctgagagtttgtaggtgggatactgtcttttatccttccacttggagtcctgcctggctacaggaagtgactacttcaggatctatataccccattgcttggaatctgagctacagtcacccccatagacattctggggcaggtctccccataccaggtctctggtatgtcctagagattgccccctagccaatctcccttctctctaccatgttctccctacatttgatctcacctactccactgccctccccattccttctcccactcagtttcctccttccatagaccttcaatatctattttgtttacacttctgagaaatcttcaaccatcccccattgtgccttcctaattatttggcttctttaggtctgttggttatatcatggttatcagcgagtacatatcacgcctgtcctttgggtgtgtgggttacctcactcaggatgatattggctagctacatccatttgcctgtgaaattcatgatctcctgtttttaatagctaatagtattccattgtgtaaacaaacaatattttctatatccattcttcatttgaaagacatctacgttgtttccagttgctattagtgtaaatcttctttgaacatagctgagcaagtgtccttgtagaatggtggatcatctcttggtatatgcccaagagtgatatagctgagtcttgatgtaggcctattcctaatgttatgagacaatgccaaattgatttccagattgtacaagtttgcactcccatcagcagtggaggagtgttcttgttccacaacctcactggcatgtgctgtcctttgagttcttaatcttagccattctgactggtgcaaggtagaagctcagaggcattttgatttgcatttccctgatgactaaagaggctgagcacttcatctctgtttagctctatttagccctggctgtcctggaactcactttgtagactaggctggcctcaaattcagaattctgcctgcctctgcctctgcctcccaagtttggggattaaaggtgtgtgccaccactgtctggcccctaccccatttttaaattgagttatttagattggtggtgtctaacttcttgagttctttttataatttgcatattagctctctgtcaactatggagttagtgaagatcttaccccaacctgtaggttacccttttgacctgatgacagtgtcctttgacttcctgaatattttcagtttcatgaggtctaatttattaattgttgacattagtgcctgagcctttgatgttctgttcaggacgttgtctcttgtagcaatgagttaaaggctatttcccactttctgttttattagattaagggtagcttgttttatgttgaagtctttgatccatttgagtatgagttgtatgcagggtgataaatgtgaatagatttgcattcttctacatgcagacatctaatttgaccagtaccatttgttgaatatgctttgtcccttttccattgtatgattttggcttctttgtcaacaatcaaatgtccataggtgtgtggatttatttctgggtctttgattcaattccattgatccacctgtctgtttctaaacacataccattcaatttttattaatattgctctgtagtacagcttgaagtcagggatagtgatacctctagaagttcattcagtgtctggggtcatttcatcttagctattctattctattctattctattctattctattctattctattctattctattttgttctatttgcatatgaagttgagaattgttctttcaagatctatgaagaattgtggtggaattttgatagggattgtatcgaacctgtagatttctttttataaaatggccattttcactatgttaattctaccaatccattagcaaggaagaattttatgtcttctgatatcttcctcaatttctttcttcacagacttgaaattcttgtaatgcaggtcttttacttgcttggttagagtttcaccaaggtattttatgttattttttggctactgtgaagggtactgcttccttaacttctcagcccatttatcacttgtatagagggtggtgacagatttctttgagttaattttttatctagccactttgctaaaggtattcatcagctgtatgaggtttctgatagaattttgggggtcgcttatatatactatcatatcaaataagaatagtgataccttgacttcttcctttccaattcaaatccccttgatctcctttattgtcttattgctctggctagaaaaacaagtgctatattaaagagatgggggagagtgattagccttgtattctccctgattttagtggaaatgttttaattttctctacatttaatttgatgttggctattggctttctgtatattgccattattgtatttaggtatgcccctgtatccctgctctctacaagacttttatcatgaaggggtaatgaaatttttaaaatacttttttagcatctagtgaagtgatcacgttattttttctttcagtttgtttatatggttgattttgttgatggattttcatatgttgaagcacccctgcattcccaagattaagcctatttgatcatggtggatgaagtctttgatgtgttcttggatttggtttgtgaggattttattgagtaattttgcatcagtgttcataaggaaagttgttctgaaattctctacattgagtcattgtacagtttaggtatcagggtggcagaggcctcatagaatgagtatggcagtgttccttttgtttctatttcatggaatagttcaagggagtattgttattagctcttctttgaagatctggtaggattcagcactaaaaccatctggctctgggcttttttttttttttttttttttttttttttgattgggagaattttagttattgcttctatttccttaggggttataggactgtttaaatagttcacctgatcttgatttattattttttacaggtacaaagacatagtctatattaatatttttgtttttttatatttttagatttttttattggatatgttcttcgtgtatatttcaaatgctatccctttcccgatttccctccttcctggaaacaccctatcacatcctccctccccctgcttctatgagggttttcctccaaccacccacccactcccacctctatggtttcgtaactgtatatggggtgaatcccccaggtgggacatctctgggtcgcctttcctttattctttgctctatacttaatatttgctcctatgagtattttgttctccttctaagactccttcccacactttggtcttccttcttattgagcttcatgtggtctgttaattgtatcctggttgtttggagtttttgggctagtatccacttatccgttagtgcatgccatgtgttttcttttgtgattgggttacctagctcaggataatattttctagttctatccattttcctaagaatttcatgaattcatcatttttaatagctgagtagttccattgtgtaaatgtactacattttctatatccattcctctattgaaggacatctgggttctttccagctcctcattattataaataaggcttcaatgaacgtagtggagcatatgtgtatatctcactagaaaatgatccattttgctaagatttaccaattttgtggagtacaggattttgaagtaagaactaatgattctttgaattttctcagagtctgttgtatgcttggccttttccccttgctgcttttaaaattctttctttgttccacacatttagtgttttgattattatatgatgggagaattaattttcttttctgggccaatctgtttggtgtcatgtaaacttcttgtacatttatagacgtttttatcttcaggttagggaaataattttcgtctatggttttgttaaagaagttttctgggcctttgagctggaaacctccacctccttctcctcctcctcctcctcctcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttggtcttttcatagtgtctttttttttcttggatgttttgcctcatgaccatttaagattttatattttctttgaccaatatattgatttcttctatcacatcttctacacctgagattctcaattctgtcctttaaatgaataattttgacatgcaataataaccactattcctttactaatgagacaacctgcttcaaattattgaatcactgtacagtcagtacccaaatgttaagacacaactaacccataactgaaacctatattcatgcttcacttgtggacaatgttaaataaatacataaaacttaattatagtgtatttagatccaaaatacagccaccacaagcaaatttttgctttttaaaattcttttattctttcacaacctacacatatacatcaaaagctattttatcacagcattcctactggtctttgctgtgtccccctgctccccagttttactgagtggcttcttccaaagtctctctcccactataatgagttttcattatggcctacttacttaattaggtttgctacatgagcataagcatgggtattgaaatgagtgaatgaaatgtagcagtggctacaccgatgtgaatatggcactcttgtcccaagaaagcattaaataccaatagctactcaaagaagagatatttcttatgatccttttccatttataatggaatgtttatggacccagcaaatctataggtcattactactactgttaatttatagttgcaaaagccatgtcatatccagaaaacatcatttcacagcactccttatcatcctgctctgaatttctgctgtcttttccacaatgttctttgaatcctgaagagaacgtgtgagagagacctaaacagtcactctataaacagcatattgccaaattacaggtctgtagtaaccaccactgacttcaattataaacttctttgacaaaggctaagggcttcagtaatttctgagtataaacaaatatatttacaagatagtttcatattatgcccatttaacataatgacagtagaagagtccaccttagggccaatgtcctccctagccatggacttgtgatcaggtttataatatctgaattgtgcccttaatatccaatctcagcatgataagttacccctgtaacagtcatgatgctattgtatcagtgaatacatacatcttgcctgatgggttaatattgtaaatcacaggttttatagctggataatatcattgataacttttctcctatggcaagcctatatagcactttctgctgctatgaaagctagccaacagtgaggaagcttccagctcagtttcagtttgatttatgtatgtcttattacccattgatataatgttttcaggaattgggactcactgtctagttctattgataatatactatattgatttaggagtcactggggcctccctgaacaacatcatgcacaggggaatctaatacttgtcattgacattttcatttaataatccataatccacccaagcagaggacttcattttgaacattttaactagtttacaaaataataggttttccatatgccttctacatacaattcttttactcttctctcatatatttcattcccagcacaattttcccctccctcccttaccctgatccttgtcccctcccattcaaccccctcaggaaagagcaggccacctagaaacaacaaccaaacatgatgtaagctacaaaaatacaagacccataccatcatatcaaagcatgataaggcaactgagtagagagaaaagagtaggcaaaagagtcagggacagtggccatgccaactgttagtatttctatttgaacacaaatctactaagctataagatatatgtagaaaacctaggtcagacccttataggttccctgatctctcaagttcccattagttgaatctgtggggcatgttctcctggtatgtctctgacccctctggttcttcaaatccttctcaacccctacacccttaatcctcagcagaaattctgttaggctgcctgatcctttgcttggtactctgcatctacttccattagctgttggatgaaatctttctggtctccttgatgatgattctgataggctcctgtcccatcacattctacaagcaggacaaatggtaggttgaaggttttatggctgggttggtgtcccaattcctccacttgaggccttgtctaagtaattaaagatggacagttcaagccctgtctctcccacaagtagtgaactttgctagggttactttataaattctgtggcactagatttccaactgcccctgaaatgcttcccaattccaaccatttctcccaggattttcttctctctctgtctcagtcccctaccttgtgtataatacatattcattattcagtcatcagttgagggaatcctttattttttgaaataatgaacaattatatttctagggaacttttgtttgtggttgaatgtttcccagggagtgatcagtaaactgatttcagctgtacagaattttcctcaatttatcagaatatcagaatagagtatggaggcaagaattatacatcctaaagacatgctctgtctataattttgaaggaaacaaaaggattatacagaactgtacctcatgaatttaatactgtattttccttattttctgttaaaataattgtggcagtctcaaatatgtatttgtggtcaagtatcaagaatgtagtacaaaatggtaataatcttaacattcatagagtgcagaacttgttttattttacagataatgtctgtgctgcttttataacaaattggtaagctaaaagaaaaaccttatgcaaatgcagaatgtaattaccattttcacaattttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttcccacttaaaaaatattttcaggaaaatattcatcattatagagcaacaactattttgatattccacttatttttaaagaaatcatttttagtattttgttatcatctatggtcagtgataaaaaatagtatctgcatttaagaggagtaacaaggcagtttaactttatattgtttttccaatgtttatgtaatttatacatgtatccacatatactctctatatacgcatatatatatatattgatatacaaaaagcatgcgaaggtgcatacatgatttttttataaatatgaattcctacatataaatttaagtagaactttctaaatatctcattaatttcttattggcaataaagaggatgttaagaaaaatataagttcaatacaaagctccatgactattaccatttattacaatattcacttattaatgtatttgatggtatcgtgtcatttgagtcatgatgtcaaaatttaattgcaaaactactttgattcttgactataatgttcttaaaatataatacatataaaataaacttaaaatgcttttagatgtcattctactatagacagaatgagtaatatcaagataacaaatgatgacaaatggatgttgcaaaacagtaacccattgtaggtggaagtagaaactaaagcaggatcttcacaaaaggtagaattagacatatcacatgatctagctatgccactattgactttatattaaagaaagtccatatcctactatagagattatttgggcatccaatttatttctgcattagtcacaataaccaggaaatggacacaggctatatattcaccaagtaatgaatagatattgaaaatgtggtgcattttttaatggagtactattcaactgttaagaaaaaagtaaatggatggaactggaaataatcattttgaatgaaataactcagacccagaaaggcaaatgttatttgtttttcctaggtttgaatctttacatatgtgtgattcaattgaagtacccatagtagtcagacaactaaaaaggggtcaaacttcttaaaaaagaagagatggtatacagatcatatgaagggggaaaggagaacgatagtgacgaaaactagagttagaaaatatgaatgtggtgttgaggtagaagtatggaaaggaatacctcacactaaagatttctgaaactgctaaatggaaactgactattctagaaccttccccaaatatatacatacaattatttttaaaaaatcccacagagtgaccctgtaattgggggagggccaatgcttctctaggcagctgacaatagcaaataatagcccaatgcttaatatgttttacttcttttggaatagttgtccatccagtagggttcccacagacacccaaacattgcattgaacttagacttctattacccttagttctctaaattctcttcaaaattatttgctttcatagcaagttattttgaagccttaaatgtatcaatcacttcaaactaacacttcagaaatttcaccatacttaaagtcaatatttttatgttggcagattttgtagatttaagatttagtcagaaaactatatgtaattcttcattttataagaaaaaataatgtttaatttccttaatattaagcaacaataatgttaattataatattgagggttgttcatcaagaagtagatcacaacaatttaccctttggatgattatgaggccctaatgattagccatatacatgattagccatatacatgattagccatatacatgattagccatatacataaggaatgagtaacatgtccattctcagttctattttgaaagatacttcagttaggatactttattgtgatttctcttttttgctcataataattaattctttgagaattccatagaatgcatacatattcttcctctccactcatcccagatctacctcacttccctacatgtccaactttgtttcctctctgttaaaaacatatcaaataaagtttatgttgcccatatactcttgagtacatgtccattcacaggaacgttgtaagcccagtgaaggtcacactataaagaaaaatgactctccctttttcagtagttatcaactgccaatagcttagatacaagagggaccttattccaatcaccactcagaattatggaattttgttttctggcctgagcatgcatcttgtgaatggtatttcaactactgtgaattcatgtggtgaattttgcccacttgtgtccaggaaacttttttttctttttttttttcttttttgtctacaacctatggttcttgttatcagatctttcttttccttcttctgccatgatacctggcccttgggaatgatagagaagtaacattttgggctgtgcattccacagtcagtttttctctgcacctttactagcagtgagtatctgtgttaatttctgtctactgcaaaaatttacccaatgtgtggttgactgatgcactaatctatgttataataatcggttattaagtcagtttattattgtgatcgagtgccagagtagtagtgtactaggttttcccctggggcctatgacttttctggccataagttcgtggaccaagtaacagtgccagttaatgggtttcagttcctggagcaggccttatactcaatcagaaagtagttgggtactcacatatcattcgtgctattgttataccaacatgcagggcaatcattgtagcagcttccagggttcagagctggataaaatcaatgattatgtttctcctctagaagtatgcatagcatcctcttgcactatgaaagctagccagtcgggatgaagcttccttttgagtaccagcttagtacctatgcattttatgactcaagtctatggcgtcttcaatgataaggtcttgatatcaagttctggaaggtaaccaggacaataacttgcaatttttggtggtttatgttatcttaattgccttcaattccaaagaatgtaacacagttctagttctcattttttttgtgttatctagtaaagccattatagccttgttatagggtaactccgttaagtttattaataaacggttttattttattatgttttttgcatgttgttgttccacttgcatcaaaaaataattaatgcatctggcattcatcttacgcctaccttttggttttctatgattaaaatatctggcatattttctactctttctccataaaagttggcatatatacattcaaattgctgatgactctataccagtaaatatctgtgcaatattaacttgacttagtgtgatatcaaaactaaattcatgaagttgggaggatgatatattggtgggaaaccgggaaaaactgaaagaggggttaatgtgaccatatttagttgtatatatgtatcaagtatttagaaataagggagagccgggcagtggtgtcacaggcctttaatcccagcactttggaggcagaggaaggcagatttctgagtttgaggccaacctgaaaaaaaagtgagttccaggacagccaggactatacagagaaaccatgtctcgaaaaaccaaaaacaataaaaaaataaaaataaaaataaaaaagggagaaagttgtagtaaatttaaagtgtttttaacatctgagttccatataggttttcaaaacaaaggataagatttccttaagatactcaaaaccaatgtatttatttatttatgttctcaattaatgtgatttgtaacacacacgcgcgcgcacacacacacacacacacatatgtatatatatatgaaaatgtacttactttcttctaaacattcatacctctcttgttttccctaattttggaccaatatatatgcaatgatagttaactattttcacttcaacttcctaatgcacagagacttttaagaagtgtttggttgactagcctataagaagtacatcagaaaattaaaataaaattaatattataggaactttttattgatttatgattttatataatgtcttgaatcaagttcattatcttattctctcttatctcctcaaatcattctccaaactctgacaactttttcttaccaccttgaccctccacccccaactgtgtccacttagcagtgcctgtatggtcacaagaatagaaccatccactggaatatgaggagcctttctgaggtcacatctctggagaaaactaactcttctctcacaaaccatcaactaacaatagctcttcaactagaggtgggacttcctgattgaccttcactgtccatggtgagattttgtctggcttgatcttgatcataaaaactgttagtttatatgttcaactgcccagttgtgtcaagaaaaaaaaaactgttcttactatagtcattcacttcctatatctcttactctatgttttcttccttttctgtaataatccctggggccctggaggggatcatatgatatagggcttatatagcactaagaaagctaaccagtaaggatgaaacttaggatatcatatggtatttaggactgagcactcaactatctcttattctctgcatgtttactagttatggatctctgatttaattcttatgtaccattaatagaagcttttctgattaatattgagagctgcattaatctatgagtgcaatgatgtcttcaggaggcaatttacttctgtgacacttagcaagatgatagcagtaggttctgctctaaggcatatttactctctgaacttggtgcttgcttactcccttaacattcatgctactattgcatcagtaggcataccatatcaggttggttattattatagttctcagggttcacatctaataaagactaatgatgattatttttattccctgatagcatgcataggaattttgagcactatgtaaagctagccaggaaagatgagacttccaagtcaataccagtttcatttttctatggttgatgactaagtatgtgatgtttgttaacaataggcccttaccattcagtcctagatagtaacatattataatggcaatagcgtgtaatgttgtgttgaaagggtggtctataggacttcagtggccaacaacttcaaagtaactgatctatgccactcggctttctttttattattctatgataagtgttgccattgttgtcccaattatatggtatcttaaaaaaaaaaatctggccgggcagtagtggtgcatgcctttaatcccagcacttgggaggcagaggcaggcagatttctgactttgaggccagcctggtctacagagtgagttctaggacagccaaaactactgagaaatcctgtctcaagaaacaaacaaaaatattttgtatatgcttatatattaggaagctgacatagttttacaacataactttttcaatcctttagtgtgcaatagccttcccatgtttccttctcatccctgcactcccactttccactttacttaaccactctttgagcttaaatcaataatgacatagagtcctgtaggatactactatatattttattgggtaaccatgctatatgttcactttagagagagggtcttagaaaaggaatctatatcaattatacaaagatatttgctggcaagtagaaaggacaacttagcccatgatttaaaacacatataggacaaatcgattttaaatatgtattgataagtaatgttttctgatgttctaactgtccagataatctttcctgttagaaaatttcattcttataaacatacaagaagtcctttgtctgagttagggttaccataaccaaggcaactcttacaaggacagcatttaataagggctggcttacaggttcagaggttcagactattatcatcaaattgggaacatggcagaatccaggcagccatgatgtaggagaagctgagagttctacatcttcatctgaaggttgctagcagaatactaccttccaggcagttagggctagggtattaaagcccacacccacagtgacacacctacttcattaaggccacacctcataatagtgccactccctggcccaagcatatacaaaccatcacaccctttaattttccaattacttagtgaattaaaataaactatatagtgattttccacaattaaacaaaatgcagatttgtggagcccagtcccaatgaatatatagataatacaactgttatgcctaggtgcagatagattaaaaaaccaggtgagcagggtatttttttatttcctacaaatttcagaatctacaccacagactgcctacacatgacttgaacaaggacaagaatacatatgctaaaatggttggagctagaggtaagaagtgggcagaagaagtccaggaggcctctgtctctgtaaagaactagaactctgggccactatggaatactgagaacaggacaaattgtcatccctaaggaagataacactaattggttgtccaataccaaatggttagccctaaaaattaaatacaaataacattacacagactgagcaggtatctttatagaaataaaaatgctgtggatgtagggctaatgtaacaacaagtaatgcaaaaagatttcatgaatttgaaagacagtgaggactggtatataggagactttggagggaggaaagggaaggaaaaatactagattgtattacagtctcaaaaatcataataaaaaaataacaggatctgtgtttattggttccctttcatatagttattactcttagtctttcatgataggacatatatttcttataacagagtctttgacacaggaaggtactctacatgctatgagcaagaaacatattcaccaagccagatgcaaacccttggattgtcaatggtatcccgcttgcagaatatgctaggataatgatcacaggaagcttgtggcaaataaccaaccaatatctgatttgaaataagatccactctactatgtgaaacccagacctgacactgcttttctgacaaagaaaaggttgagtctgtattccagccagatcatactgtaattaatccacagcatgtctgcattctagctgtattacatagacctagaaagccattgaatgtgataccttgacagagaagccatgttgctcaattaaaatttctctccattggaacacttagcactaaaggagatgcctctatcaaatcctctttaaggctctggatacccttctgaagaggaggctgagtatcagaaccagtgggattaaaatacaccaggaaaacaaggccctctaaatcaaagtaatcaaatctcatatgaaatcacagagactagagaagcaagaacaagacatccatgagcctgtcccagctcctctgagtatatagtatggtttctagtttagctcccagtttagtgcttttgttttattacctttattttttgcagtccaatcattacctccctctaggtctgccctcccacagttcctcatcccattcctcctcccccatctccaagaggatgtccttctcgttcccactccctgaggcctcaagttgctcaagggatgccaggcctccccactccctgaagcctcaagttgctcaagggatgccaggcctccccactccctgaggcctcaagttgctcaagggataggtgcctctcctcccactgaggccaaaccaggaaatcctctgctgtatagtatcaaggggctaaaaccagctcttttacgttacctggttggtggctcagtgcctgagagatctcagaggtcaatgttagttgagactgctggtcttcctatggggttgttctcttcagcttcttccagcctttccctaattcaacctcaggggtctctgactttagtttaatggatctgtgtaagtatctgcctctgtctcagtcagctggttgttggacctctcagaggacagccatacttacatcctgtctgtaagaacatcatggcatcattaatactgtcagaccttggagcctcccccttgagatatatcctaagttgggctggtcactggatctcagtctcttctctacttttgtccatgcagttcttttagatgggaagaattcttggtcagagtttttgactttaagatggccatgccatccctccacttgatgccctgtctttctactggaagtgtactctgcaagttccctctccccactctaaggcatttcatctaagataccttcttttgagtcctaagagtctcttacctcctagctctctggtaatttctatagggttcccccacctctcatcccccaaggttgtatatttccactcattattctggcccccagggcttctctcctgcccatccttcatgaccatgttccccttttctcctcctgctcccctctccctcccaggtccctccctccctccacctcctgtgatgttttcttctccatcccaagtgggattgaagcatcctcattggggccctttggcttattaaccttcttgagttctgtggattgtatcctaggtattctggcttttttttttttttttgctaatatgcacttattagtgagtatataccatgcatgtacttttgggtccgagttaccttactcaggataataatttctagttccaccaatatgcctgcaaaaatcatgtccttgttcttaatagctgaatagtattccattgtgtaaatgaatcacattttctgtatctattcttctgttacgggacatctgagttgttgtttccagcttctggcacagataaggccactatgaatatagtagagtatgtgtccctgtggtatgatgatggggcattttgggtgggtgtatatgctcaatagttgtatagctgggtctttaggcaagaatgtagagaaagaagaacactcctccattgctggtgggattgcaaactggtacaactactctggaaatcaatctggaatttccccagcttagcgtttttatttttacaagaaagtttgattcttgtgccgcctcctgggctctttttcatttttgtttgtttgtttgtttgtttgtcttaggattggtttttatcttattttgttttattttcttataactccttagaagcctgtttgtttcctaatgagagacagaaagtgagtgagtctgtatacaaaaggatatggggaggaacttagaggagcagagggagggaaaaccatagtcaggatatatttatgatgaaaaagactattttcactgaaaagaaaaaagttaagaaaatcatgattatgatcttgatttttcattatcctatcacataaaggatgtttaattattattaatttatgacattacattttcaacttattgttgctgcaacaggagtggagacagaaggaatcagcaagggtcaggtcctagtgagagatcctgcctcaaaaataggtggaaagctcctgaataataatgacaaatgtaattgatttctaccaccactgatcccccccacacacacacatatccatgaatatgcatgtgtgtacagacacagaaaatttgaaataacagagtaagttagtattttccctcctcctgctacctgtaaaattaatgtgaattttgcatagttttgaagtgattaggcatggatatattctccagttcttagctaagtaccaataagtactcaaccaactgaaataaattacctgtgtaaaaatataaaacagcttatcgcaaagaagtgtttaaaggatagttgttgtggaaaatattaagcgcccctcccccctggagctcctgagaactggaccaccaaccaaagagtatacatggagggacccatggcctctggccgcatatgtagcagaggatggttttgttggcatcagtaggaagagagagaggccattgggcctgaggggtttgaagccccaatatagaggaatgccagggtgggaagacaggaatgtatgggtaggtggaggagcaccctcatagaggcagggggctgagggatgggatagggggttcccaaagggaagacctggaaaggggaaaatgtttgaaatgtaaataaaaaatatccaataaaaaaacgaaaaaatgaaattcacactaagccagctggccctggtgagctgactagccaggcactggcaggcatggccagcctattctcatctcatggaggctctctgattcatgcttcaaaatctcttcactcagctcaccaagttctcaatgatggtcactaccatgccaaccccacacttcaaaatgcccatggcttttgggggtgtactttttgcaaacccacactttgccaccatacctttctctctggaactcagttgagccacctcgtgaatcaagacaccacacaagcttagttcagaatcaatgattactcaattgctgggtgcaacaactacacccccagagctcccagggactaaaccaccaaccaaaaaaatacacaaggaaggacacaaggcttcagctgcatatatagcagaggatggccttgtctgacatcaatgggaagagaggcccttggtcttgtgaagacttgatgccccagtgtaagggaatgccaagacagggaagctggagtgggtgggttagtgagcagggtttgggggatgggacagggggtttttggaggcaaatgaggaaagggaataaaatttgaaatgtaaataaagaaattatctaataaagaaaaaaagttcaataatatgttgcatggtaaataactaagatgattatgataatcaaattgtaagtcttggtaaatatttttaatttttaattttaaattagttataacatataatttaaaaagaagtttcacaagctttgtataccctcttgcagtttcaaaaatgtgatcatcttgtataaacaatatattacaaccacaggaaaaaaccctaaaatcctagttttgtaaaccatattaaatccaaatcctagcggatttgccatctaaactgaggaacacttgtagctacatcttgtccacctgttgaaccactccaagagcctatttctctctcctgcctcttctcttcctccctccaacccggaagtccctcctactcacccagtgattggtttctttatcattagaagggtcacatgaagtcctgagtaagtgattcattactgtcccaggcagcccctctcagaagctgaactagcatcaaagtacaaactgtacctgggctatccatgacagacggccattacaaaacagctatttaaaaaaggtatcacaggtatgatcatagacaaatgtaatccaggcaattccttaatggaggttgcctctaccctgaagaccctggttgtgttaatctataaagctaactatgacaatggtcattctaagtcatgagtattgactgtcagaatgatagcatccaaaaccctgattctaactgttgatatagtcacacaatttgaagcaagacatacatagggatattctgggggaattaatttctagacatccattgcactgagagtacacacatcatttatagttcacattttgaaacagtatcatctatattgtgccatagtgcagcaattattttttgttctcctgttttgtggttgctgttgttttgtttgaatcttgatttattcacctacaaagaacacattgaatcaattccaaaggggctcatagaaattccattttcctgtaggggtaatgagtgagaacccacaattattttataaggagacagaaacatctgcataaaatattccctctttagtttctttttatagatatatttttttaccttcatgtgcattggtgttttgcctgaatgtatatctgtaaggtgttggaactggaactccctcaaactggagttacagacagtcctgagccatgcatgatatggctgccaagaattaaacccaggttctctagaagaacagctggtacccttaagtgctgagccttctcttttgcccacttcttcactttctcaaatcacttaaggtccgaaagtctgcaatgaattcaaggggatagacactatgagtttttattttgattgccatcttgacatcatctatagtcacctaggaagagataaacttcacacatgcttatgggagattacctacattagggaaactggggttaaataacgtaccttgaaggtaggtagcaccattgtttagcatgcagctcttgactgcttcaaaaggaaaaactactgagcttaaggattcatttgcctctgcctcctgactctggatacaatgtcatcagcctctaatctttttccactacacctttcctaccatgatgtcttgtgctccttaaccgtatgtgtacataagcccttgattcttgatattgcttttgtcaaagtgttttattacagcaataataaaagcaactaacacagatgcttactcttctctttgaaaacttcatttaagtgtttgtaacttacacttttatcttacttcagttataatatggttccagaatctttccttcctgattattccatggttctctcatctctaatatcttgggatctctgtcccaacttaacttctacctttacagctttattcagtagcatttattctttcatgaatgcagatcctcaacactcagccaaggattgcctagccgcagaagctctctgaatccgtggggcaagagtctgtgagcactcttagatctttaatgactatatggttccatgtgaatgatccaaagctgtaaccatctttgtatgataaccatggtgaaacatattcttaggcagttcccttccaaatattggggatccctttggcattctgagtttaatctctattttcaaatgaacttgcatttataccatggttggcttcttaccttcagagaaacaatcttgtagtcacaaagtaaaacagtatatttttctttaaaacttgcagcctctattccaatatacgttttagttgtaactttgagcttgttgaaaatattttctcccaagaaactgcacacttttcacatccttctgccccacttattattcattttcactgtagatgtggtaaaagtggcaactattaactgtgctactgactgaatgccagtttaccttgaaaatattttccactaagcaaatcatttcatagctacagtattcagcttcactaaagttagaagacataggcagaaaacagcctcattggttttaccaaaatattacccaaataccttctagccctgttcagatagtcattatttctctctaataacacactagctgggcctcatgtcctacatttttctttttttaatttttttatttttttaatttattttttttaattaggtattttcctcgtttacattttcaatgctatcccctttttcttatcattgttttcttaaatcctataagaatggcccattaacctctgcttacagcatctctgggcttgtccaggtcaaagctattccacatttcctgttgcaatctagttatggagtcttaagaaccatatagtcaaatttatcacactaacaacctcaggacatggtacattttttttctatatcagttccatttcttcttgctgaaagaaaatacctgacataagcttcggagagatgactgaacccaggatgatttgccaaaagacaaaagtttgatcctagaacccatataacacctcacaataatctctacctgtaattccagggactttgacactcttttctggccttctaatgcaccagggacacaagtggtatatagacatacatgcaggcaaaaatacaaataaaagcaaaatctcttaagaaaatagttaagtttcctaaaaaaccaggacatatctattgaaatgttatacaaaagtatattatcattgattcatatatatttaaaggtatatgaacttgtactatgtagtagtatgtgtagtagtgtggtgatttgaataagaatgtctccttaatgtaggctcacacatttgtatgcttggttcccagttgtggattatttggaaagtattaggaaatccatgaccttgttggaagaagtatgaaacactctctctctctctctctctctctctctctctctctctctctctctctctgtctctnnnnnnnnnnnnnnnnnnnntctccctctccccttgtccctctcccgtctcccctcttctctctcttctctctcctctctcttctctctcctctctctcctctctctctctctctctctctctctctctctctctctctctctctctctctctccctccctccctccctccctctctccagatcagaatgtaaaggtctaagctacttttctagcactatacctgcctgagagcagttattctatatgccatgataaccatgagctaacttcctgaaactgtaagcaaacccacagttatgtgctttcttggataaaagttgagtttgtcatgctttctcttcacaataggacaagtaactaagacatatatctacaggtgttttacatcattaggaaaatacttctaattatagctctaattcttattttgactttcattataaatttctcatatgcacatatgcatactcatattctatattgtgaggttttatgaatagctttgtgacttttaaaatatatacagaataacattactgttttgaaatataagatgtacctgccttgtagattaaaaaaaatcatgttctcctcttagtgacaaagattattgacattacatttacaagaaacagattgaaaagactgcaagacacatttatttaatcaaagtttaacacaatatatacttctgaaacaaagacaaaaaatccctaggaataataccatttttgtattttggttcactaaagaataaaatgacatatatcaaagtgattttgagatgtgttttagtttgtatgatacactgtaaaggggaagggagagacaggagtaaagacagtaaaagatcaaagtcctccttgctccagagaccttcatgtatccttcagctgtaaggacttagcattccaagccaccatgtgtggggtttcatgttctaaacccttacactaaaacacacttttaacaattataaaatggttttcaatgattatgaccgaaaagataataaaagaggagctgtagaaatgcttcagtaattaagagcacatgctgctcttgcagaaggtcaaccttcagtacttgcacacatgctggcagtccactagtggctaaatctctagtttcaagagatatcatgctcatttccatgagcactggatttatatgtatagcctccacatgaatgcacacatacataaaattttaaaaataattagaaaagaaaatataagaaatatgtctacatttatgaaatatatgtaccagtaccaacatgtatttaatattaatatatgcctgtactagattcaacttcatatttattcattttgtgtatgtccttacatatggtgcacgagcatgcataatatggtatacatgtggagtacaacttgtggaaatctgctttctccctccaccctgtaggacctggggattaaatactggttatcagatttgaccatgagcacctatacccattgagtcatcttgccatcccatattaatatagattagtaagataaaagttcaattaaatttgtactattttatcttaaaatattacctaagttataaaagaatagatatttgtaagactactttctaatccaaagggacaaaatgattagtattcctaactttaaatgaaagtcaaaagcaataaaggattatatatgtctaaaacggttataattcactactcttgagctgatggtaattatctgtgtgaccttgcaaaagtaatttaacttcaattaagttccatatagtcctctacaaaatgagagtattgataatcagatatgagtcataggattttttctggattaaataaactgttatacacaaagcataaacagcacccaaataactcactatgtctaatcattataattgttattaattacattaatattttaatattgttgttgatctatctgttcctctaggctaagcatcttaagaacagaggtatcacagcttggtaaaaaaaaaattgttttaacagttaatcaggatccatatctctagatgcttgaataaatgacctattattagttgaatcaataaactcttggcttaactaacaataaaatgaatgatagtcatatgaatttatttttacataattttcacatttatcttgttgtaagaacatcactcatggatacgctcatgcaagcacaatcacatatatagcacattagatacaaaatctgtcattcataatgaaattaaacatattaagttacaaaatttaggtttttgcatttctaagaggattttcgtgataacgctataaccttgctttattagattagtaaatgtttgcttttaattgactaagagtaaagctcttgttttttgttttttgtttaaatgtcaatttttttttaacgcacatagtctacattaagatcctctgagggtcaagtaacagataagcagttcaagacagaccaagagatgtattgactgagtatcaaagtctttgttgggtaggattgtcactgtcctcagttacagttaaatctagatgttcattgatgcctgtttctcactcccatttcctgtctttcctccttttcttctcctttgtcctgtagtgttctgagttcattcctattcctgtcttggtctttccacttctctgtactattcctttttatgtatccttggaatggcttatttctttaaaaaattctgcctttctggttattaaagtagttataaggcattttcaggcttcttttacctttggtgactgtcacttcagaagcacttgcttgttatttacttagtctttcatcacatgccttggtcacatactgatgcttatggccaaggatatgaaatattctaaatttttgcatgtttgtatgtctttttgtttttatatgatcggtagcctggcatattggtgtcaacatttagtttttaagcaccctgttaaccctttcccctttcttctttccataattcctcctcaaaatattacccgtatggtgagagatctatacttaagcaatataatattgctcaagtataatattgcttaatattggacaaaacttaaaacttaagagctaagttgtccatcatgtggtttccattttagttatgtagttggtatttcaaaagtagtcagtgggaaagataaaaatctaatctttttaaaaatattgatatagtaatgcatatttaccatttaataggggtccaattacagaaaatgtggtatatttacacaatggagtattactcatgtattaaaaagaatgaatttatgaaattcctatgcaaatggatggacctggagggcatcatcctgagtgaggtaacccaatcacaaaggaactcacataatatgtactcactgttaagtggatattagcccagaaacttaggatacccaagatataagatacgatttgctaaacgcatgaaactcaagaataacgaagaccaaagtgtggacactttgccccttcctagaaatgggaacaaaacacccatggaaggagttacagagacaaatttggagctgtgatgaaaggatggaccatctagtgattgccatatctggggatccatcccataatcagcttccaaacgctgacaccattgcatacactagcaagattttgctgaaaggacccagatatagctgtctcttgtgaagactatgtcggggcctagcaaacacagaagtggatgctcacagtcagctattggatggatcacaggacccccaatggaggagctagagaaagtacccaaggagctaaagggatctgcaaccctataggtggaacaacaatatgaactaaccagtaccccagagctctggactctagctgcatatgtatcaaaagatggcctagtcagccatcactggaaagagaggcccattggacttgcaaactttatatgccccagtacaggggaatgccagggccaaaaagggggagtgggtgggtaggggagtggggggtgggtatgagggacttttgggatagcattggaaatataaatggggaatatacctaataaaatattttttaaaaggggtccaattaaacttaaggatatttcctgaccaataaattgatcaatcttttcaattaatcctagatgaatgtcatcttatttaacatggctattacaatggatgatttgttgccattctcattgattctatgtcggtcatcactgcaaagagaggcccattggacttgcaaactttatatgccccagtacaggggaacgccagggccaaaaaggggcagtgggtgggtaggtgattggggggtgggtatggaggacctttgggatagcattgaaaatgtaaacgaggaaaatacctaataaaaaaataaataaaaaataaaaaaagaaatattttgtacaactaacaatgaaacaggtgataaaattatatataaaatatgtattaaaagttgctgccatataacatgagattggtatcagcatatcagtccacacgccatctaaatataagtggctactattctaagaaataaaccaatttccaaggaaactcttaagacttcagtaaatgaataagtattttatataagttgctgacattcacttagaaaatttttaaatctgataatgtgtagagtatataataagttgattctttaattaaaattctgaccaataaatagaaagatatttatgcataaaatttaggaaatgcataaaaatatttctaaaagaaaaatagaataaatagtttagctgaaatgaaagaataatttgacactgaaaccacaaagcgattggaatgatgattaaccaagaagataatattgaataaaatattatgaagaacaaagaagagtcagtgtgggctttgaaaggaaatgttatcttggtaaaaagaacattttcaattatgtaaaaaaaaatggggagactggcacacgggttatgctgatatgtgagtaaaatagtgataatattgaaaaatatttttggagtgagaaataatttttaaaaggaatcaaacccagtaatggacatgtcaaatggactgggagaaagtccacaaggccccaaccttacacatagaacttcatgcaaagcagtaggagacctggtctgtcccactcagttatccagtgccaaacagccctgaaaacatacacacaattatcattatatggactgaacagggtacatttatgaatgcatatgtatatgcatatacatgtgataaaagacatgaattgaagagtaggaagaggtatatgagaggttctgtggagtagacagagaggggtaaaatattttaaaattataacaataaactttgtgagacagaaacataataagaacttaaacctgaggacaagatacatttttttacttgacttcatttattggcaccttactatggtacaggactttcctagacattgtgtattatatcacaagtgaaaaaataaggcttgttcttcattagtctgaggctgtactagagaaaacaaagtaaacagatgttttatcaagttacagaagtggtagttgtggggccacatgcctctcaccctggttttaaaaacatgtagaagtaagaattggataaaatacaggtatgtgtaaatggaaggaaaggtcaaaggcacaacttttcctagagggtgaatcattcagcaagtatatttgcatctagccatttgtgatctatttggcttaatgttaattgtcctcagacaaaacaaagggtgaacatcagcaaactataaagataaagcactgctgattgcctttccaaactatttgtgaggttttaaatttcaacacgccttagactaaaatagtatcacctggattgtataagtaagataccaaagtttaaaagaataatgataatgaagtctttctcttttaagttcaagtaaacatcattaagagaaacagaaatcaagtagaatattcaagggcagtggagaagtataatagggtaccattgctgggtcatgggtcccaatgctaacagaagcatatatatttatataatatatatatatatatatatatatatatatatatatatatacacacatatatatatgtatattttttctggagtggaatttaaagtagactaaaactaaaacaaaaaggaactctcctatatagcttaaccttattacttctagaaatctctctaagtgcctgacataaataatttttcaattcttgtcaaaaatatttgttataatcatatcacacataatttccctgttttttctattattttaaaatgtaagtcattctaactataatatctatcaacttttgtgaggagcacagaagataattagggtgttttgaactgtctatacacaataataacatttttcccccgtactagaatatttaaggtatttacctaattttttttaaatcaacagctttcacaagaagttcagaatgtttacattttttataaatataaaaatgttaatcttgctttaatgttttctccttggtgtacatttgtccagaaagcctgttctatgactatatcataatttagacattaatatattaatagaatttaaaatacaatttaactcataattaacctaagcttttatttgtgaattgttggtagtctatatgatggtgattataagacatagattatgcatgacaatatcttcttactgcaaaaccattttataagtgaaactaatatagagtattattaactcagtcattttagtatttatcaagaggtttatatttattttccttgtggtgtttaatatttgttctaaagtagaactttatttatttgactatgttagccactaaaatatatgcagcttaaaggatcccactgagaaacaaacttgtgtatgtgtgtgtgtgtgtgtgtgtgtgtgtgtgtgtgtgttaataatgactaaatcctgaattgtgggtttggtagatgaaaatactccactgctgattgctatgctcagcctttactaatttatattgtactactcacagtatcttacctcatagagataatatttatgagttatttcttcaggtatattaaaccctgatatggattttcaggaggaaatgcacattgacactttggtcctgtcatggcgatatttatacagaaaatcaattcttgtcacaattactgtggaaccatctagataaacttgttgtggttgtttagataagaatgaccacaatatgtttatatatttgaatgtttcttaaccagaaagtgatgctgaatggattagcagaaattctcaacctgtggttcatgacccctttagaaggccaataatcctttcacagaggttgcctgtcaaatatcctgcatctcagatatttacactgtgattcaaaatagtaacaaaattatagttataaagtagtaatgaaaataattttatggttggacggcactacattaagaagtgtgctaatgagccaggcatggtggctcatgcctttaattccagcacttggggtggcagaggcaggcggatttctgagttcgaggccagcctggtctacaaagtgagttccaggacagccagggcaatacagagaaaccctgttcgaacccccccccgcaaaaaaaaagaagtgtgctaacatgttgcattattaggaagggtgtgaaccactggattagagaattaggtggtatgtatttgttgaattaggtgtggacatactcatttgtaaatatgatgtatattcttgggcccaaaattcaatttttatgggaactattttcttcaagaatactacactctgagtatggactgacagaaggaaatgtatgatgacaagttgaaaaaatacattcataaaatactagttttatgcacatggttgatttgtaacatgatgtatcttcttacaccatagagataatatttatgagttatttcttcaggtatattaaaccctgatatggactgtcaggaggaaatgcacaatgacatgttggtcctgtcatggtgatatttatacagaaaatctatccttgtcacatttttgccagaatatcagcttaagatcaaaaaggacatatactcagtgaaaaaatatcatgatcaattggaaaacttcatttgtatttatggaatctttacatggtaccagatactcaagaacataggtgacaaatagcagatagtcttgtgataaggcttttgaaatttaattaggtgaattcttctaaatattcaaatacttaacaaaacaaaatgaattatattgtagccttaagaaaatatgaaaactcaaaagctaggacagattataaatgaagctatcacacacataaaagtatcttagagtaagtatttgaaatgacctttgacaaaaaaaggtgaaaattagagataccccagacaagacatttcctaagatatagagatagaaaattcaaggatataaaattaaagagactactttgacagatatagagagcattgaacctatggtgatactgagagaaaaaaatgaaatgttcaatatagcttttaggtcacatcccagtgtgatagcagttgtgcataattctgtaggaggtaatgatttctgaagagggagatgtgtcatcaagcctacttttgagaaaaattgattcagctgtcagatactagttaaatagactcgaggtaagattaaagagagggataacaccaacttcttaacaagggatcttaagctagaaatagtgagggcatgactaatatagtgagaatgaactaagaaagagatggttgtaaaacatatagtgtagagtaggactacactggttagcaaatgactggggaaggaaaggaggagctgataatgactggttccctgcttgggtgactagggaatgtgatattcgaagagaaataggaattgggatagatgatatattctggcttttgaacagatttagcaggctagattctaagggtgattggttgaaaaatgctttctctccagagcaagagagaaagacaggaggatttgggagttttcatgtaaaataatcttagtgtgacagaagaggagctctgtagcctatttcatggtagaaactcatattacttgagctgtctccctttccccacatctgccaaccagctgtctttcttcagtttgaacatggaatctctgacatcttgaatcaaacatctctatgtacataattcagttagaaatatcattttccctgaactttatgttttttcattgagcctagttcttaggaccctattctagggtaattataatctggctttctcacaaatgctcttgtctcattttaaaagctataaatccttgttcagcctacttttagtaaaaccgtacccataagtggtgtttagaggcaatgcattatccctgggtctagttttgcttgtgctcctttctagacatatttttaacaagcataaatacatttactgtatactccaaaaataaaaccctgctctaggtgctcatcagacatacagaattcaattaaataattctgacagcaatataatctttctatagaaagatgctctgaagtgtgtctctcctttgccatatttagtttttcctgtgttcctctgaacttatggtataactggaacactggttcatgtgaaacactttttttttcctttctctgtctttgtcctaataacatggagaagaagcaaacaaaaaagttcctcagtctggacactgtggttgtttttaaattaccatagttaaaattaatttgaatacagaacacatctaactaactgaaagctagcatgctgctgctgctgtgtactgatctgtaactcactctgtgtaaaaaatagtctcttttgttggattatattttaacttcctgtaattgaccattatgctagcagaatcatttagatattacataaataatatttattgggccctttttgtctccatgtgagtgattgttcattatatataacttatatttaggataaagtacatgacctaagaatagtctctcactctttttagtaagttgccaaatgtatgggaaacaacgagagagattcatagaaaccctatagatgaaaaaaactttttttccaacatatttgggaattgtataaaatgtaccttgatcacatttgcttcacattcatcctaggtccaccctcccattcttgtgcccctccacaaaacatatgccaagtttaaattgttttgcacatatactctttggagcatggtcaaacctcccagtgactgctatgctagctccttaaagattgctgagtcttttcccatccccacccccaaacccatcaactgtgaagagctacacttcagcatctttatcacagttttaaaggactcttgtcaatggcttcctagcttgactgtttccttattagggcgttgtctcagaagccttcaatgtctcttattctcaattccgagtcttcagacatcaatagcactgcaaaagaaccttctttgtccataacaggtgctagcaccacaaattatggacttctacatggtttctagcagtagctaatttcagtaaaaatgaagccattgtgtgcattatatgaaattatactgttttgatgttaaggagctggaattctgttggagttttgtttttttgtgtgtgtgtgtgtgtgtgtgtgtgtgtgtgtgtgtgtgtgtgtgtgtgtgtttggtatatgtgtttatgtgttcacatatgtacacttctatgatggttaatgtgggtattctcatgtgcgtgcatatctgcacatatatacttgtgtgtgaaggcaattgattaaggaaatatcctgttttaagacagattctcccactgaacctagaactcactgatttacctaggcttcctggccaatgtgctccaaggatttgtttgtccctgccttatcaatgctgggattctgtgtgtatgataccagatctggaatttatatgtgtgctaggaattcaaactcaagtccacatgcttgttcaagaagccttttatcaactgtatgatatctcctgcccttaaaaatttagaatttttcaaaagaatggttggacttatatcatttgtaatttatctaccttgtctgggtgtattttaattgtttattacagatattaatacctttttcctggaaatatgttgagagtttagaagatgtcatatatgaaatgttttgaatttcatatgctacataaattttcagttgtttatgttcaataaagtttaattacataggaaaaataccatcttgtgctctttgcactcattttcctattggaaacaaagcataaacgcttcacttgagaagaagcttcccatgtctatttttgaaaattctatttttttcagaacatgaacttggttactctacagtgtttctatagcagctgcaacacttgttcatttcaaaagatgtagcatagaaatcagtgttgttcaccactgtgcatttatgcctggctaatcctgacctactgttatctttgaccttcaccatctatatttgtttataaagattgttctgttttccatttgttatgattcaatacaagaaaggaagtgagatgagatgctgaaacctctaactactccattttctcagttttatgtgaaatatttaatgtgctaggttttttacaaaagaagtaagatcattttatttcaagcaaagtgatagcacatgttatggagggacatgctatcaagattgatggcaggctctgtgaatgaaaatattcaatggccttaagctgatatgatatctgtgccttgagttcttaattttcttgcatttttcatttctacatgttaaaatgtgagttggtgatttctgaagacagatataagaatatctatatgcattttatactcagatgtcatttattgaaaatacagatatattttttttaattgctggctgctaactttaacatccgtagtttcctaacgataatggtagctagcagctctttctcataatttttgttcagtatcctcatttttttcacggtgaattgttttgcttcattttgatttgaatgagatgatcattccctgtttcctttggaatattatttgtgaggagtgtctgtgatcctgtataaaggggaactcatgtagagactatttctattaacctaagcaggagtccaaagtgtaaccattctgggaatcactataaattcaatcaaattcatagcttggggtttgggggtctatccaagtaataagaatttgtgctataaatctaccttaaggatatgtattaggtagagagggtcgggtttagttatgtttcatcatttccttctagaggaggtatcccttagctttttaggtgagatccttctaactttagatttgactaggccctcttttcatcagctgtttaacccctcctctaactctgtattaccattatacaatctacattctacaatcagtaaacactctctaggaaaatgttttcagcagggaacttaaactctgatgtctgcctttaacaacaaaataattatataaatgaaagtttagcaaaagaatatctaactgtcttataaactaatggatgatttaacatatcagcctataatatttgcttatctttagtgggagggattgtataaataaatttagcttaaagtgtcactctaactagaagttctatgacatatttttccgtgaagattcaccatcatggtctctatttaacatcatatttcttgacataattcttacctttgaccacagatatcagaagtctgatttttctttccatttgaacatattgttctgtttgaagaaagcatagctgagcagcacacatcatggctaagaggaaagagagaacatggaattcgggtactagacttctttttactttatttctccttatagtctatattgccatattgccatagtctataacatattactgcccacattcagagtaggtctccttatccagttacttatctcaggaaatgccctcacaaacccatgaagatgtttgcctccccatcatactaggggttaataaatccagcaaagttgataaagactagctactagatgttcaacccctttcagtttgactcttaaatatatttcaccttaagtcataaattctggaatcacaactacttttgtctatcttgcaatgtcaaataaatttagtctctcaaagagtttccattgttgcaacagttccaaatttgtttgaaactccaaatttagtgtctcctctgaactcaaggcgatctttcagctatgagccaagtcatatatttcctagtacagtggaacagaataaagtgaggaatgagtggtggcttagatagtgggaatagtaccaaagcatgatgagagtaaatactgaaagttattttatgttttagccctgtgtctggcatcagatacataaaaacatcttcatgtgtgttctattagttttgggaacttatgtgccttggttttgccagtttttggtccaaatgatttgtctttgtggtattgtaatcctttgtctgttgtgtctttggtagatcatttactttcctatcatctgtcacattccaggggttctcttacactattaattacatttcttaggtgcatgcattatcttttcaaaagccacccaaaggagttctgactctactgtacattttcttgtcctctcaggaattcagtaaggactaggtgaaatccttatttactgtgtaactttttcattttgcatatctgcaaaactaacacatgttgaaatttgacttgtgttgtaaaatattaagaagtgggtctttccatatgttactatgtcaatatgtttctcaatactatgaaaggattaatggtgtttcagaatgaaaagaatgggtttagttcagtttcctctgtattatgagacatgtttttgagaggcctcacttctcctttcacttatgacatatcatcgaatctcttactaaatgtggacatcatacccatgaaattccaaacaaccatgatcataatcctaagaattcttcctatttataaattacccagcctattgcatttgtcctaactctgtttcagttgctgagataaacactctgaccaaaagcaatgagggcaaatcaacgcaggatgtgaggcaggaacttagagaccaaggaggaatgctgcttactggcctactctccattgcttacttgctctacttttatatagagctcaagactacctgcccaggggtgtcacaacctacagttagcttggcattcccccaatcacaattaatcaaggaaatgtcatagatacttgtctacactaaatctgatggaagcatagtctcgattgaaattcttccttccaaacattctgacttgagtcaagatgacaaactactaatcatgacaacattaaaatattacagcagnnnnnnnnnnnnnnnnnnnnccagcaccaacacaccttgggtgcagagtctgcggacacccccccaaggtcaccacaggactctccactggatcttaggacctctggtgaatggaacacaactactgctccaatccaatctcgagggacctgagacagcattaattagggaagcaggaaacccagcctgaccagggtcacaagtcccttccagtcagcaccagcaccggggcaccttgggcacgaagtctgcagacagcctcaaggtccccagaggactctctacaggatcttaggacctctggtgagtggaacacaacttctgccaggaggcaggttcgaacgccagatatctgggcaacttccctgcaagaggaaagcttgcctacagagagtgtttggaccactgaaacataggagagagttagtctcccagatctgatgatagagactaacagaatcacaagaggaacaagctctaaccagagacaactctaacagctgactccagagattaccagatgacaagaggcaaatataagaatcttactaacaaaagccaagaccactcaccatcatcagaacacagcactcccacctcacccagtcctgggcaccccaacacacccgaaaagctagacccgtgtttaaaagcatatctcatgatgatggtagaggacatcaagaaggattttaataactcacgtaaagaaatacagaagaacactgctaaacaggtagaagaccttaaagtggaagcacaaaaatcccttagagaattgcaggaaaacacgaccaaacaggtgatagaattgaataaaaacatccaagacaagacctaaaaagggaagtagacacaataaagaaaacacaaagtgaagcaacactggagatagaaaagctaggaaagaaatctggaaccatagatgtgagcatcagcaacagaatacaagagatggaagagagaatctcaggtgcagaagattccatagagaacatcagcacaacaatcaaagaaaatacaaaatgcaaaaagattctaactgaaaacatccaggaaattcaggacacaatgagaagaccaaacctactgataataggagtagatgagaatgaagattttcaacataaagggccagcaaattcttcaacaaaattatagaagaaaacgtcccaaacctaaagaaagacatgtccatgaacataaaagaagcctacagaactccaaatagactggaccagaaaagaaattcctcccgacacataataatcagaacaacaaatgcactaaataaagacagaatattaaaagcagtaagggaaaaaggtcaagtaacatatgaaggcaggcctatcagaattacaccagacttttcaccagagactatgaaagccagaagatcctggacagatgttatacagacaataagagaacacaaatgccagcccaggctactatacccagccaaactctcaattaccatagatggagaaaccaaattatttcacgacaaaaccaaattcacacattatctttccatgaatccagcccttcaaaggataataacagaaaaaaaagaaaacaatacaaggatggaaacaacgccctagaaaaagcaagaaagtaatccttcaacaaacccaaaagaagacagccacaagaacagaatgccaacattaacaacaaaaataataggaagcaacaattacttttccttaatatctcttaatatcaatggattcaactatccaataaaaagacatagactaacagactggctacacaaacaggacccaacattttgatgcttacaggaatcccatctcagggaaaaagacagatactacctcagaatgaaaggctggaaaaaacaattttccaagcaaatggtctgaagaaacaagctggagtagccgttctaatattgaataacatcgacttccaacccaaagttataaaaaaagacaagcagggacacttaatactcatcaaaggtaaaatcctccaagaggaactctcaattctgaatatctatgctctaaatgcaagggcagccacattcattaaagaaagtttagtaaagctcaaagcacacattgcacctcacgcaataatagtgggagatttcaacaccccactttcatcaatggacagatcatggaaacagaaactaaacagggacacagtgaaactaacagaagttatgaaacaaatggacttaacaggtatctacagaacattttatcctaaagcaaaaggatatacattcttctcagcacctcatggtaccttctccaaaattggccatataatttgtcacaaaacaggcctcaacagatacaaaaatattgaaatcgtcccatgcatcctatcagatcaccatggactaaggctgatcttcaataacaacataaataatggaaagccaacattcacgtggaaactgaacaacactcttctcaatgataccttggccaaggaaggaataaagaatgaaattaaagactttttagagtttaatgaaaatgaagccacaacatacccaaacttatgggacacaataagagcatttctaagagggaaactcatagctctgagtgcctccaaaaagaaactagagagagcacacactagaagcttgacaacacacctaaaagctctagaaaaaaaggaagcaaattcacccaagagaagtagatggcaggaaataatcaaactcaggggtgaaatcaaccaagtggaaacaagaagacctattcaaagaatcaaccaaacaaggagctggttctttgagaaaatcaacaagatagatgaatccttagccagactcactacagggcacagggacatcatcctaattaacaaaatcagaaatgaaaagggagacataacaacagatcctgaaagatatccaaaacaccatcagatccttctacaaaaggctatactcaacaaaactggaaaacctggatgaaattgacaaatttcttgacagataccaggtaccaaagtttactcaggatcaagttaacgatctaaacagtcccatatccactaaagaaatagaagcagtcattaatagtctcccaacaaaaaaaaagcccaggaccagatgggtttagtgcatagttatatcagaccttcaaagatctaattccagttctccacaaactattccacaaaataaaagtagaaggtactctacccaactcattctatgaagtcacaattactctgatacctaaaccatagaaagacccaataaaatagaagtcttcagaccaatttcccttatgaatatcgatgcaaaaatactcaataaaattctgctaacagaatccaagagcacattaaaacaatcacctatcctgaccaagtagcttcattccagggatgcagggatggtttaatatacagaaatctatcaacataatccattatgtaaacaaactcaaagacaaaaaccacatgatcatcttcttagatgtggagaaagcatttgacaaaatccaacacccattcatgataaaaggcttggaaagatcaggaattcaaggcccatacctaaacatgataaaagcaatatacagcaaaccagtagccaacatcaaagtaaatgttgagaagctgaagcaaacccactaaaatcagggactagacaaggctgcccactttctccctaccttttcaacatagtacttgaagtattagccagagcaattcgacaacaaaaggagatcaagggaatacaaattggaaaagaggaagtcaaaatatcactttttgtagatgatatgatagtatatataagtgaccctaaaaattccaccagagaactcctaaacctgataaacagcttcggtgaagtagctggatataaaataaactcaaacaagtcaatggcctttctctactcaaagaataaacaggctgagaaagaaattagggaaacaacacccttatcaatagtcacaaataatataaaatatctcggtgtgactctaactaaggaagtgaaagatctgtatgattaaaaacttcaagtctctgaagaaagaaattaaagaagatctcagaagatggaaagatctcccatgctcatggattggcaggatcaacattgtaaaaatggctatcttgccaaaagcaatctacagattcaatgcaaccatataggtggaacaacaatatgaactaaccagtaccccccggagctcttgtctctagctgcatgtgtatcagaagatggcctagttggccatcactggaaagagaggcccattggtcatgcaaactttatatgccccagtacaggggaacaccagggccaaaaagtgggagtgggtgggtatgggagtgggggggagggtatgggggacttttgggatagcattggaaatgtaatgaggaaaatacctaataaaatatattaaacaaatatatatacatacatatatagatacatacatatatatatacatatatatatatatgggaaaaaagaaagtgatgtggttaaaaaggtcactttagagataagaaacagatgaaataaaatcatgcagaatgttaaatctcaaaaaaaatcattacatacatttctctactcattttgactaaggtcaatttaaaggattaatggtttattttggaattacagttcatagaatatcagtccagcatggcaaagagagtatggctatgtgtctaacactgaccagaaagtagcaaatgatgagtgtcaagatttggctttttttcctctttttaaacatgattttatttttatttttatgtgcattgatgtttcacctgtatgaatgtatgatgatgtcaggtactctgcaattagaattgcagacagttgtaagctgccatgtggatgctgggaattagacaccaatcctctggatgaatagtcagtactcttagccactgagccatctatctagtccccctttttccagtttttattgcatgcaagacctcatcgcatggggtattgctttcaacattcaaagtgaattttccatccttagtcaaacatttccagaatcaccgtcatagacattccaattttttctcattaattacctaggaatttataaatcaaattgacaatcaaaattaaaaagtttaagtggacccttgtcaatttgatatctttaagttttccttttgaaccttaccctgtaatgactgagctgtttttccaggtctcatcatgatatctgaacacatcactttaaaatataatattatattcatggttacaatagatttctaaatatagtggaaaatacatttgtactactttcaaaactcactattgagttttgaactcactgtttaaaaaagtcaccatgtcttagctattcaacctccaaggtctctcctgactcaaaggaatcaaagcaatgccaaaatctagcaatgtgaacagaacaacttgtagatctatacatggagtctgggactgttgtacctttatctgggttccaacagtgttaggtgctctgtgcatccacttatgatgcctgaaggaaacagagcacttctatagggttgtctctactccatgcctaaactttaacttctaaaattcccatagtactgctatctgcaagagtgtattatctcaattgataacatggcttcattttcaaagccccgtgcaacaatccatcaaagactccttacaggcaatcagatcttgtcacatattgtctacccattataacttcctgtcacattagtgcaagctcccaaaaccaagcaactgtggttgatttttttatgcttaaaatgcaaagccacgtgaaccacgttattaagttaacctgtcagatcaataggtagtctaaccttcttctataatatttttgttgtttctgaacctataaaccaggcaaaacacttctatagttgttaaggatggcattcctgtcatttggaggcattgttatttcagtatgtatttacacttctatacagctggagcaaaattgctaatgtttttaacaactacagatgcttcatcagtatccacctttcctacaacatcttcaacaaactatgaatttttgctatcttggttactattctccttcaatataaacttgaataggagtaatgaataatgaccattccatagtttcaaggtaattctcttttgaactgtattctactaaaaaatgccttattaaagttcttaagacaatcaaaatgtagttacattccttccaaaattgatctatgaatgacttctagtccagtttctaacctgtagactttattctttaccacagtcttgggagggggaacttccctacctttgttactaccagtgttctcatctaaaagacttctaaaagaatgatctattaagttatcctaaaggagtccaaaacttatctagctttagtcttctgataagaggactcatccctgggagtagctaatcttcttctaacagcagtcatggctacccatatttctttatctaggagtgagaccctgtgaaaaatttccccttccatattaacatgttcattgatattgatattcttcaggtcttgtttatggagccatttctaggagaagtgactgttgcatggcagatttcctagtattatgattcttaaaatgtttcagctccctcttccatagtattccctgagtcctatatgtaggagctgtgatgtgtgtgtgtgtgtgtgtgtgtgtgtgtgnnnnnnnnnnnnnnnnnnnntccattggtatctacatcatgatcaattgtggaattttgtgatagtctccatttgctataaagataagcttttttgatgatagatggtaaatatacttgtctgtggatataaggataaaatttagaatatactaaaagcatactagtaagttatgttaatctatcaatgtggcattagtaggttattttataaggcccatgacgccactagatgtttccaataactgacattatttccctcctgccttaaatccaatttgacagctgttaggtgctatcatcatgtgagtaccatttatcatacctttatgtatattttttcatgactaatttttgaggttcattgggtgtataggtgatgcaacagaaaagcctgtttaattccttccctcccctggcatcttgtgtagtactttctgaaaccattgaggctataaaatagggaagagccatttagataagatccagcttgagtcatctgagtcttgtgtactaagtgtggagtgtcttccgcaaagaggcccaccctcaacccctagaggaaatatcaataatctgtattcttttttttccatatagcctttttttaaattaggtattttcctcgtttacatttccaatgctatcccaaaaagtcccccatacccacccccccaatcccctacccacccactccccgtttttggccctggcattcccctgtactggggcatataaagtttgcaagtccaaagggcctctctttccagtgatggctgactaggccatcttttgatacatatgcagctagagacaagagctctggggtactggttagttcatattgttgttccacctatagggttgcagttccctttagctccttgggtactttctctagctcctccattgggggccgtgtgacccatccaatagctgactgtgagcatccacttctgtgtttgctaggccccagcatagtctcacaagagacagctatatctgggtcctttcagcaaaatcttgctagtgtatgcaatggtgtcagcatttggaagctgattatgggatggatccctggatatggcaatcactagatggtccgtcctttcgtcacagctccaaactttgtctctgtagctccttccatgcgtgttttgttcccatttctaggaaggggcaaagtgtccacactttggtcttcattcttcttgagtttcatgcgtttagcaaattgtatcttcttttgagagttattcagaattgtttgatcaaactttgaatggttcctcatggctggtactggaagtttcattactctatatctatagttcttgtgaggagcattgtcaggccaagtgtcttgatttttatatgtaaatgaaaatatataaacacatacatatatgtgtgtgtatatattttacatggataatgtcacataccacatatgatatgaatatattcatatacacatatattcaggtaaatgtaaaactatacatataatatatatatatatatatatatatatatataatttattgagtctatattaaacaactttgctgttatttgtccctatatctccttttgtgttgacctcctactcccttccccagtttgagccccatgcctgttaatctgtttccaaatacaaataattgcatcctgttactccattctctagcttcctcgcacatttatactttcctgaattctgttgtaactccacattgtttgctcacagctgatgattgtttccttgacatttattgagtctgtatttctctgtattctggatattaattctttgtaagatatagaattgccaaacatttatatctcccagctggcattctcttgtttccttttttattcaatatggtaccatccatatttctcaattatgtctctgcttgaaaatcttcacatacatattaggatgggtgcctctttaaagccatacatagttcttaatttatttaatcaagttaatcattaagagtaaccatcataaaataccatgttattttcacattcctttctctgaccattttttcacacatcacaaatgttaacattgtcaatgacagaagataaaaatattcaacttgtatagataatatgaaaaatcataatccttcaattctagttgtccaactttgcttatttttaaagctattattaattatttattgatgctaccttcatctgttcctgagcattaggaaatgttcttatgaacattttttatttttgtggattttatttcactcttccttacaaccatcccttaagtaacaagtcctttttgctctctttcatatgtatggccacattttctgtaattgttgttacacatagtatatgtggataaataaataaatataacttgcttagttcatataatgttacatcaaagtttatgttttcagtgctgccatggtgcattagataaacaattgctgtgttttccctgagaaagaccatttctccagttctttctattccttagttgtctgcagttctttacctagagtagagtctttatgaactttttctcttccatgtttgcatgtctaattgtggtgtctttgttcctgtagtgtttaatagccatgttacgaggacttcatagtcgttgcttctctgacatttctaggagtcacaatctcatagcaaattttctgttcctttagctcttaaaatcttttggattcctctcctataatgatccatgaaacatgatgttcaggagttttgctatagatttatcagttagaactgggctccatgtttcttagatttaattggttgtgattttctctattggcctctgtctgttacaaaagacattttcttgaggtggggcaggtaaaagttacatttatctatagatgtaaggattaataattagaatgtagtcagagatagttttgattaaatgaagtggtggttgtaaaatcttttccaaaaaccaggatgtaactagacccaggtatttggctaggattctagtaccactcatgaatgtcacttcttgttcaggcttttagtttgtatccttggtttcatctaggtaattgtcatttgcaagacattactgtagaactggtggataatatttacatgagatattgtcttaatctttcattatatttgcatttttgcagtgagatctgggatgtggacagaatagatatgggcagcaaaacagatacactggttgacttaggactagtggttagatatagcttaggtggaatacagtcagatagatacagggacttgattggtgaccagtctgtttcctgcttcacacttggagcttggagctagatatggaggatggagtgggtatgagtagtgaaggaccaggtagactcacttggctggtccctggagaaggctaaatatgttctggttgggtgaggatatttgatgtggtataggagggacttgaaagctggtacagataggtcacatgctgatagaagcctataggttattaccagaacaagtagaggtggtcagataaggctggggcactgtctttgggacttgagctttgtgtgaggggtttaaatggtatgtgtaggggaggatgaagcagccagccatctatatctttgagaaataggatatgtttcttatatgtagttttactagaatcttattatttactacattcttatatgtatgtttactatatgtagttttagagaatatataaatatttaattaacatatatatttcatacacaaatatttcattcataaaataattaacaaataattttatttgtaaagcttgtaccaatattttctgtgatatacatttcactgtgatatttataccaaggttatgaatcaatctgatattgctgttatattttatacaagaataaactttttatattttattcataaggacaaaattttatattttatacatgagtataagcttggaacaggagaaacaccattcataacagctctgacaaaacctttcttttttattatcagttaaatttctttaaacatatgtatgtttcacgtactctgtactgattatatccaagaaatatttgtggcataaggttataaccaacaactagcaaagtagtcctcagtaatgcgctttggcaaagcggccaaaacactaacataaatggttctcattatcaaggtttcaacaactgagtctactactgcagtacagaaaatgttgaaatataaattaaggtgataaaaagaatgatgaatgtaatgattagctagagcttttggatacaggaaaataataattatacagcagtaacatgtattagggtagaaaaataaaaataatatattctatgttcttacatagggcttctcaaacaaaagatggataaatataaaaaaagaggtaactgggggttgaattaaattcataagtggtctcattagaatatggacctaaattcaatttacagaacccatataaaagttcttgatgtatggatatgtacatataatcccagtgttaaagaaatagagaaaagaagatccaggtgcacactggccagaaagcctatcctaactggtgaagtcctagttctaaaggagggaggtatacaggttttttgatgatgaaatatgagatttctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggactggaactcaagcaggtcaggaagcaggagctgatacagaggccatggagggatgttctttactggcttgcctcacctggcttgctcagcctgctctcttatagaacccaagactaccagcccagagatggtcccacccacaaggggcctttcccccttgatcactaattgagaaaatgccttacaattgcatctcatggaggcatttcctcaactgaagctcctttctctgtgataactccagctgtgtcaagttgacacaaaactaaccagtacatatggtaagcaatactaagacttattctttctccatcaataacaattgcctgtgattttgtaatatttttcctggcacagataaagtaatgtctttataatgaagatttctaaataacaattgaattgcattgtaagatcttaacttctctggttccagggctctttttctgcttgatgattcttaaatattcacctcaaaataattatcctaaaaagacatattttagaatggactattctctcatatagtcttatttggagtgctgttttaatattctacaattttaataagcaatgtcataaaaacataaaaatgaaggtaatctaaaagatctctagatggaatgtaacaagtaaaatatgtaattaaattagaaatctgcatctttatatttttatcattgtcagataaacttccctaaatatatttctgctgttcatgaactccactaattagagccaggaaatactactgacataagactgtaaccaacaactacaactgtaatcccttttgtttgaagaagtgtcagaataaaatctaattaataaatggagatatgatgaccaaagttaaaatgaggataatgtaaataatcaccataactctttaaaaaaatttttgcaagttatgtaaactacttctatttaactgagaaattagcataatatagtttgatcatatttattctaactactccctttattcatcctatgctcatttctacaattttacctacctcaacatcatatgcttttcttttattttaattaactagtcaactcaaaagtgtgcctccgtatatttctgggtttggaacaatctactggagaatggtctatctaccaagagcaacatatttaaatgaaactacttcctcccacagtagaagccatcagttccaatagatctttagttaagaacgatggctcaagaaccccatggcagtccatgctatgttgactagctttatattgtgcagggaaccacagctgctctgagtttattagtggtacagttctgtaatgtccggaatgtactttctctctggtcctccctgacctctcactcttacagttattctgcttcatattctatgatgattgaaccttgggcaagaagggtgattcgatatcccatttttggttgaacactccataattactctctctggttttgtcatttgtatttctgtgttaagcatctattcactatatgaggaatgttctcatgtgaagtatgaaaggtgtactaacctacaatgatagagataggggtttagagggcagtttgatactatgcctatttagcaaaattattagtaagtcacacagaagctcatgagatttccaaccatgaatttttagccagattagaagaaccagtttcctcctgtgaagtaggccctaggttcaacagaaataacctgattactccaacaacattcctgccactattgtatccatgagcatatcttaccacattggtcattactgtagttcactaggttcacagctgggtaagactactgatgtctttccacccaagtagcctgcattggatattccagtactatggaagtgagccagcaaggaggaaatttccttttctatatcaatttgatttctcctcatttataactagtgcagatagtgtcttgcagttaattcctggtgattaacatacaacttgaggggagtaatcttatacctggcactaggctactaagctttttatttagcaactatgactcctgtcattatcctctgtgatggataactccaatgaaaccattgtgtgtgtgtgtgtgtgtgtgtgtgtgtgtgtgtgtgtgtgtgtgtgtgtgtatgagagagagagagagagagagagaggagagaaacttacaaaagaattttccatgtgacctttttcaaatatactttcaaatatacactacactttctttaccttgccctaagaaacctcttcctcttataaacctcccttaccagtatttcccttccccttctattgcctatgttctcctctcatttaaaacctttattcctcctccacaccaatggtctttcttttttttttttattaggtattttcttcatttacatttccaatgctatcccaaaagtcccacatactctcccccccactcccctacccacccactcccacttcttggccctggcgttgccctgtactgaagcatataaagtttgcaagaccaaggggcctctctttccaatgatggccaagtaagccatcttctgatacatatgcagctagagactcgagctctgggggaggggggaggtactggttagttcataatgttgttccacctatagggttgcagatccctttagcttcttgggtacattctctagctcctccattgggggccctgtgatccatccaatagctgactgtgagcatccacttctgtgtttgctaggccccagcatagcctcacaagatacagctatatcagggtcctttcagcaaaatcttgctagtgtatgcaatggtgtcagcgtttggaggctgattatgggatggatccctgggtatggcagtctctagatggtccacctttcgtctcagctccaaacgttgtcactaacttcgggttgaaatgaatcattcttctgagtctctccatctccttcatttcacagtactcagaatgccaaggaaccatgctttgggatacttggggtattatctttggatatataacatctgctttaatttggaaaatgcagtatatttgatgatatgatttgtaacctggaaaatctacaggtttttaaatttacttaaaggatttttaactttgcaaacctcaggacacagatggagtagagtactcagaaaataattataggggtcaaaattaaataaaattaagtatatattcattataactcacatattttattctgttcaacttcatatttagttacaaatactacaaatttaatatttttgaattattactttggtttaaactttttagtgctgatctttttaattggggttacactacctggctgctttaagaagtttaaatttaaattcactaattaaaactttagagtcaagttcaaaaatttaactgttttatgtgttcagctgcttaactagtatcaactggatatatgcaatgaatattatttattagtatgttaatttactattcaagtattttccagcttccagaggaaggtttttaatcgaaaagtctttcccattaaatgtaatgctcaaattctgatataccattcctaaagtacttgccctcagatgacaaagtatgctatgctttaaatccatcacactatactgctcaacctgaagtttaactaaggtaggatagatagagatgagatggtttgaaagactagaatctagtccttggtgaaaaacaactttcagcagtaatactcgctatattcttttgtcaacagtaagctatcccacaagaagaggcttgtaattattgattcaagcctctgctttaaacttctagtattttattggcctaaagaaattacattgtaggatcaagtgataaatagaagtgcatggcaaaaggggaagaatcaggttcctcagtgaaaccatcctgttaaataagctaaactaagtacatctattctcataaattggcaattatacagtaacttcatgacctcctgcctataagtgaatatgacaagacggtgtcacacacacacaccgacacacacacaccaacacacacacacataaacatatgcttgttcggtcacattctgcatatattttacttttcacaaatataaaatttattagctgaaatactcattttcaaagactgagaaaagggtagcagtccttaaaaaaaagaaatgtcactcaaaatgggcttggtatttagtatataagaaaagcaggtctggccgagcagtggcaacgcatgcctttaatcccagtacttgggaggcagagacagggagatttctgagttcaaggccagcctggtctacagagtaagttccaggaaagccaaggctacacagagaaaccctgtctcaaaaaaaccaaaccaaaccaaaccaaaccaaaccaaaccaaaccaaaccaaaccaaaccaaaccaaaccaaacaaacgaacaacaacaaagcatctttggggagatagctcagtggttaagagcactgactgcttcttcagagatcgtgagtttaattcccagcaaccatatggtggctcacaaccatctgtaatgagacctgatgcccttttctggtgtgtctgaaagacagcaacagtgtactcatatacataaaatgaatacttctttttttaaaagaaaaaatagcattatccatttttgcatcaaataaaatttatgcataaggatatttattttcaaacacatgtcggaaaggaagcatacattctaaatatggcaaataggttgagagttccacagacattttgtgtgtgtgtgttgggtgtcacttttaaaacaatagagatagcatttgtctatcagtttaattgttttagagtaatcattaaaagatgtgagcccagagagttcattaagctgcgatgaggataagatgaaggcagacaaatatgttaatagttactgtaaaaccttttagattagtaggtaggaaatgctgattttgatttgtgtctgcaagtatatccatacattcttcacagatcagaaacgccgtttcattacaggtcttagaattgttggagccatctgccttgaagcaggttatgtgaagggggccacacgtgagcaaatgctctttgcagttcagatagtgttctgtttgaatggtaaattggagagcatgctagaatacatttttttgtttgtttgtttgtttgctgtgtctaaaatttcggaaaccaatgacaccacattttataaatcaacaatttatgtaaaactctcattttcattggagattttttcccacttccatgttcactatagtgactttgctaactagttagactctaaaacattgcagcacctaaaagacagcctttaaatttggtgagactaatagacccttcatttctgttttgtagtgaatttattttgtggaatgtccaagaagcttgaaaatagtattttagaaaaatacctctttgtaacaattttatggcaaaagtagcaccattaagtatctccactcttcttataaaatcacaatacatgaggcatggtgaggtttagggaccttagtaagctggacagctagtaagtggcagagtcaggtttgaaaattgttctggttgtttgttttgacagactcttactctagagacacatagtgatttctgcttttctgttagcacataggcaattgaagttccccttaggcctctgaaaataaaggagtttttgtatgaaatatttatttcattgttttcaattttcagttgtggttgaagaatacataaggtaagttgaccaccttgctcattttgtaggtatatgcagttctggactggaatccaccagttctagccaagtactcattgagggaattagacatcagccctatattacacatgggttttgtttttgtttgttttcctctaaacttaatactattgagtatttccatatttctggggcagagagctctataacattttcactttagaaatctctaaaccaatatcttttataaatccaatcatgctaagaatagcactctaatttgagaagaatgcactagactattatgctataacatatcaataaacaattggagaaaggagaacactgctctattttcatataccagtgtatggccagaattcaaggctcataaaaaaaacagacatgcaaaaggactaaaataattcaaaataaaaagtaattggtcttactttttttttctttcagtctgagctttgacttttgcaaaagacaaaattgatatcactcattagaatacttatgtgtaaatcataacttcaaacatttttagtagtccaaaactaaaagccccaaaggaattgtattttcttagtgtatatgtttatgtaactatttatttaaaaaatatattcaaatatcaataaatacattgttatgtgtatcctatatttttcaacaatgattttcactaagagctctcttgacattttaaaaatacattaaaagtaaaaattagataatataaaatatattgcataattacacagacagtatacatacacagctatatatagcaaaatgttagtccaccaaatagaaatgacatataaataattgcaaaattgtatagtccctattagaaaatattaataagtatatcatagtgatatttatattaatatgcattatttctataatactagtatcaaattaaatgtatattatgtattattacattgatatcaattttaattattaataaccgtaagaaataataaaaaatacattgaaaaaaacacagtatgacaaggaatcaaattcagagtacaacatggtggtgtttaggcagagaagaggaaaggatccttccttacagtttttttttccagtaacgtagaggcgtgaggaggtgagtagcccatagtgatagtaccagtatattcaataccaaatataaagctgcatggaagttgtaggagatggggggaagatagtccaggttaaaatgaacattctataatcaaacaaaatagttttcagttgataccacatagtataataatataaaaatgttattaataaaaggactattaatgttaagagtaattatacaagtgatttttttctttcttttttaattaattaattacatcacaaacactcccagtccccacctcacagaattcctcctcccatcatccctccccttttgacagagtgggaccctcctgggtatccccccccacacacaccctggaacatcacatctctgaagaattaggctcatcctctcccactgaggccagacaaggcagccatagaaactgacctgctcatctgctgtatatgtatgtgcctgagctatatatgtgtctgaggcctagttccagcctgtgtatactcttcagctgctgtttctgtatctgaaagccccaaagggtccaggttagttgactctcttggtcttctgatagggttcttatcccattcatgggcttcaatctttccactaacccttcgtaagagtccctgacctctgtccattatttgcctgtgagttatctgtatatgtttcagccagatgctgggttgagcctctcagaagacaactatgctaggctcctgtctgtaagcataagagaatatcattaatagtgtcagagattggtgcttgcccttgggatggatctcaaattgatatggttattggttggccattccctcagtctccgatccaccttttttcatgctttttcttttagacaggacagatttggggttgaaaggattgtgtgttgattggtgtccttatccatccactggaggttctgactggcctcttcagggttccatgccccactgttaggtatcctggctaagtacaaatgaattgactcctgggagcctctgccattccaggtctcttggacttcctagagattactccccaccctcacccctgacagctacagatttcattcattctcttggccccatctctcgtccttttccacacctggtcccattccacaacccatccccattcccacacaaatctcccttcctctgcctcctattactattttatttctccttctaagtgagattgaagcatccttgcttgggactttcttcttgtttaacttctttgggtctgtgtggtttatcatgggtattttatacttaataaactatatccacttatcagtgaatacatacctaccatgcatatacttttgtgtctgggctacctcatcaggatgatattttctagttccatccatttgcctgcaaaattcatgtgtttaatggccgagtagtgttccattacataagtgaaccacattttatatatatatatatatatatatatatatatatatatatatatatatatatatatatatatgcaatatccagggatccaccccataatcagcttccaaacgctgacaccattgcatacactagcaagattttatcgaaagaaccacattttctttatccattcttcggttgaggaacattggggttctttccaatttctagctattaaagatgctttgaacatagtagagcatgtgtccttgtgggatggtagtgcatctttttggtgtatatgctcaggagtgatatagctgagtcttcaggtagaaccattcacagttttctaaaaaagtgccagattgaattccagagtgggtgtataagtttgcaatcccaaggtgggatttttttcattatcagttcatttgatggtgtgaagattcataatgacttcaatttctttgtactatctaacaccctattttggagaacattcaatttttaagagactcttagaaattccttacagatctctaaatttccaaaaggtggacatgaagtaggaagtattaaaaaatttacatttaaaaaacatttgaaattacttgacaagtaattcaaatactgtcacttattttaacagcaaacattaaacattcttaacattttaaataaatgattaatgtcaatagtatttagatatcttaatataatgattatataccatcaacaaaggaatagcaaatattatgatcaagtttttcataaaagttaataattatatattttcacacttttgaaagttattttacaaaaaatttcatttctagaaaactaggaaatcagtgtatctgatatattttataattatgtatgaaatatttatatgtagtatttcaaatatgaatttaatgaagttttaggcataaataaatttaaagattgatatttttgagtaagagtgtttttacctccatgttatgcatgtgcaccacatatgtgcactgactgaaggcccagaaaagtatgtcagattctctgcaactggaattagaatgactgttagctgttgtgtgggtgctgagaatcaaattcagtactcttaatgactgagccttttctccacccatagcagaaaaattttacttttgttcttcacttttctatataactctactatcctcatatgtactaccaaagatttagaggaaataatttaaattatcaaaaatatttaaacggtttttatattcggattatttacaagagagaagagattgacccacacaagacccaggactataggaaactttacttcctcatgtgctcattgtgaatgcagttgaactctttgtgttgctggaattgccacagtatatactgaatgaataccaactatttgttcaatctgctgctgcgaccacctctaatgccaccactgttgatactactaaacaaagaaatactgcaatctctgctgagaaaagttttatttggtcttcactcagctgaaacaagctgagaagacacagatgcctggggcagcagaaaaattttgactccagtaaggttaatgacaacagcttgcttagaggttaagagccattcttgactgcttgaaccttgtatgtcacagtgtggcattgactatggaggacaagatatggctcacacaattataaacaccatatgaataatgctttggaagattattgttcctattgctgtagttgtagtagaatcaacttatacagttggggctcatcctactgagggtttgcagtaaaggaatagatttggagctccagaggtaatggacttgtcaggttgcttactgagttgcacaattatctacattggacactgcatttctggggcataaattgaactttgggtgttaatagaaggcctctgaaagagattcccataaaagatgggtcattctagctcctgagctgatctgctcaccaaaactcaggctgccagcctgagggcaaccacactgatgatgacatgggttgccagactggtttctgctgagcttgcagataactgggcagcttgaaggaaggcaccatattaagtaagcacccacaaagacatactgagaaaagctggctggccaaagagcaagaaaatcctacagctgctgcctgggatgactgatagttgaggatacttttcctgaactgtaagagagtatgactactagagcttatgcttatctgattgtgggcttcttccttggggagctgtgatcaagactattaaaatcacttgaatcatagagcatcttgcctggtcatgcaaccttggtcttgacagacccctggcacaaattgactgtgctgtcaggttcattctttgccttagccacagaaccacctgagtactcatctaagtagttgtgaaagagatacatctggttctcacatctgtcctctttgtgtggtgctatttgggcagagaaaaatggaccattaagcaattttatgatactctgcttcatttctgatggctgactgccagcttcacattcaaatatacaatcatattttacctcaggaactgctcacattgctgcttctgattcatcagatctgatagtctcttctctgttagcacacctctccacatctacttcacaagatctgacaaagtcaaaagtctctgttcatacatacctacaaaatttctgccttcagaaaatttcaagtcataattctgaccacctgtttttagtccatttttttagtcctacaaaagcaaatatagaaaatctaaatgttatcacagtttagtatgctggaggtcaaagattaatggcagcatctggtgtagcctctgttgctccttgtccacatggcattaggcaggagaagatccagtctttcacatcttttttataccatcattagtctgacacctggatgggatcctcataatctgaatatctctcattggacaccacttattagcagtgttgaattgataattaagtttccaacacattcatttggtcaaaggatatatttaaagcatatcatttggtggtcttcctgtaaggaatcaatcgtatgaacacatgggaagacaagcagtaagagtacctgctgccaccatctacattcgacataggatacctcttgcagcactattctgttgatccagtactcatttttgttatataactaatcattgcagattctgcctgccacatgttcctcacagtagttctcagttgctcagtctgtcctcatttcaaacacagcacctaatccttatcttcttgttgcttgtccttttctacttgagattgtatggttcatattgttctttgaattctgtagttcttgtttacatacagaatttaattcacagtgtccagttgcagtttccatccactttgtgaatgcaaatgtgaatgcaattgacagtggttttagctgttgaactcagttttggtctttccattttcctgaaccagcaatagaagaggctctatcaaagtaggattttgtatttggagactaattctttatgctcttgttacttatagcaaaagatgttttgaatgttaacgattactgatcatgtaatatttaaaataaatgatattcatgacattttacaagtctttggttcttctgattccttaaaattgacttagtttatcaaggttctttagtttattcaattaattgtttctctagccatgttattttaataccttcacacaaatgtgcctccatgaatttttgtttggttggttatctgattcactggtaggttgatataggagattttttttattatcatcattttctgagagaagggctcactatatagcataagtttataatcttgagttcaggatctttctgccacaatctctttaactgttggaactttgcctttcatagaaagagatattcacctctggtcttttctcctcctatattcctagtaacgtgtaacctaacacaccaggttggaaatcaattttcagtatttcctaaataaaacgtgaggctaagacaccccttaaaagttagcaaaaataggaaaaacataagatgaaaactgtattaatgtcattgttcataaaggagatcataaaatactgaagtactcaagaggatagtaaacctctaaaatgacacaacgtcaaggaaaaaataaacattcacgagattactaaaaaacaaaacatcatcaataacagtgttaactaatgatgtagggggaaatacatgttcaaaagttgttttgtgaactttaatagatctaatttttgtgcctagcccaagttttttaatatgttgtcaccatatttgaccagaatggctgtgctgcatatccctattggtatatacatatattaaacatttcctgactttctttgttttgaaaaaaacaaatatttttcctgctgctttgtgggctggcagcatacaaagatatgcagcaacattacatttaagttttatcattttgctaacacaagaacactcaaaaactgatgaattgctatgaaaaacctgagtgagcttcttctacttaatagaaagaaaactatgattaaaatcatgaaaggaaaaccagaaaaagaccttttaaaaagttctcaagtagactaggtaacaaatagtgttaatgtcctagaacactcaagcatattgtaacctgaaagaatactgagaacattaaatatattttctttcaccgcaataaactaaaaccaagggaaagaaagagacagttctgtctggagaaagttagtataatagcttagatcccaaaaattgtttatgatgaagtgacaaagaaataccatagacagaaatagagagcagagtcatatacaaaagggaagaataatcctgcacaaaacttctcagtaacacaattatgcatcaggtaaatatagcatacataatcatattattaatgatgtaactttcaacatttaggaaagggcataagctgtcaggtagccctttatttgataaattaaaaataacatatccaaagtcactattgaaatgaatgtcttattcatgttaatgtactttatcattttacaaataataactggtaaataatgtcagcagtaactacaaagtcatattatgcagaaacaattagtataatttgattccaaataagcccatattagtaaaagaaagccagaagccagaagtaatttaatagctcttaaaaattagccaccaaggtactcaattataattgtatttaaaagactagtgaacatctttgtgacaacataagatgtgtgcaagtgggaataatagcattgctgttttacgaattggaacaaaggaaagattttaagaaatagatgtccaaagaatcatgactatatatatatatattttttttaatgtgtgaacaacaatttggacaggctcagcatctgtctgagtcaaagtaattgtgttgaacttccatatttcataaaatctctctctctactatgtctataattatatacttttaagaaggaatcatgtattatagctgcaaattacagagataacaaatatgttttcaatttgttgtagaagtcatttcatatgagaagaacatatgaaataataatcttatagcactaacacggaagtcagtttgacagctgactgctgcaaagtctcctgtgtaattattctactccccccactgctagagaaatgtttttcaaatgacctgcagttttcaaaacaatgagttttaaaatgtctgttttatgtacacagctgttgacatctacaaatatttaaatatctagttctagaatccccttgttggttcagacacctaaatctaagaaaagaggaatactagtaactaataaacccttcttgttggtgttttattatttatatttttgtactactactgcatctagggatgctttcctgctttatgcttctgtgtcaattgcatctctttctggcaataacatgagacaagattaactgaatttcaaatatatgggtcttttgctcccaggaagggttttctactcatattgaacctttctataaaaatgaaaatttgaaactggggaacaaataagaagcctatattctcagtgggataaggagatttaataggaagaactatgtgatttattgcttttattagatggaactgaaaagtagattaagcctctaaaatggagtgaccttgatataaattccatacttacctagtagtgaaatataaatattaaagggcataagcaacaacatcatatataagtgataagatgcaatagatgtggtggtagtggtgttgactgcaatctaaaggtttcatacattattacaaacagaagtgaaagcagtaacacctattacatagctcgaactcattttaaaacatatctgtatcaggattctatttacttcttaataagtctatgaggagaaatgtccttgtacttttatgatcaggtttctgaatttcaggaaacataaattagttgtccatagttacacagacttaatttctctgtccatgcaaatattgtctttcagttgtattctttattatgcttaaagtctacatagccttgtgctctagtgctaacacttctcatcatattgtaacttaattatgaaattataatctgacaacccaaagtttatgatttctgacattaaaactactgtcacatacaactttttaaaattttatatttctatatttatggatctttgcctgtatgtgtatttgtatggcatagagttcagctagggcattggacaccctgggaaatggagttagagatgattatgaggcaacatgtaggtgttaggaattgaacctaggtcctctccaagaacagacattactctttttctttaaattgaatattatttatattcctctttatatttatattctgatcatggtttcccctttctaagctcttcccagattctccctattttcagacacagtcacatccacaatctttctctatctcaataaagcacaaacatgtatcaatgatgatgatgatgatgatgatgataataataataataataaaaacagaataagacaaaacatacaaacaaataggaataaaggagcaaaagtaatagaacaactaatacacacaaacactgagacatttacatttgtatacacagaatctttttgtgttacttttgcaccagttttgtttacaggtagctcatagttgtagatcacaagatttttaggtgggcttgtgtttacctttctcctctagtagcatgaagaataccttctaatactatgaagatatgaaggctctacatagacaccagctcaatttctctgtgttcaatgagttgtgcaggtgttgtcttcagtaattgggtcttgccatcagtttggacaagagccaaaagccttggcaatatccagggtgtttaggatttccacggggtctcttagataaacagctcagtaggatgtaacccattcctggcactggatggttcatttggcagcaggaaatgtttaataggaactttctctctcccattatttggtgattccaatttattttcatttcatatatgtatgtattttaagaagattctactgttgtaggtttctacagaacccctgaatacccctgagttttagctgtccatctctgtattatctcccttggccccttcttcctgtccactccacatttgatcctcccattccagccttgcatgattgtctattctatttccacttcctaagaagagccttcccttcaccctcatccctcattgtattttaacctctgtggttgtatagattgtagcctaattatcaaagacttaccagctagcatccatatatcagtgaacaacatggtactgacataaaacagacatgtttctaaatacactcaaattgaagacagatgtaagtacacgcacccttatacatctgatatttttacttaaaaaaaaaaaacagaaacacacactcgaaaaaaagagcacttttaacatatggtgctggtcaaactagatggttgcttgtagcaaaatgcaaatagatccatacttatgtcaatttcaaatgtatcaagaaccccaacataaaacaaaatatactgaatctgatagaagagaaagttgggaatagttttaaactcatttccacaagaaaatactttctaaatagaatgtcatttcacaagcactaagatgaacaaataatgggaccccatgaaactgaaaggcttctgtatgtcaaaggacaccattattcagaaaagcatcagcctatcaaattgcaaaagctttttaccaactacacatccaaaagaggtctagtatctaaaatatataccacaataaaagaacaggatatcaacaaaacaaatcttccaatttttttaaaatggagtacagatctaaacagagttctcaaaagaagaaaaacaaatggctaagaaacacttaaagacattgccaatatacttagtcacaaaggaaatgcaaatcaaaactactttgaaattgaatcttataccaatcaaaatgtccaagataaagaaaataaataacagtccatactggtgaggatgtgggataagaggagcactggtgggactataaacttgtacagccacaatgggaaacagcatggcagttctttgtaaaggaagatggatacctgaagatccagatataccactcttaagtttttaccgaaagagtgtatatcctacaacagagatgcttgctcaaccatgtccattgctgctgtcttcataatagctagaagtcgaaaatactttacatgcctatcattggtttaggtgataaagaaaatgtggaacttttacacaatatatattgctcagttgtattaaaaaagaactcaatcatgaaattttcaggtagatatatggaactagaaaaaaatataatcccgagagaggtaacctggttctcgaaagataaaatatgatggatattttcaaccagagttctttaagtcctgagctatctttccaactttgacataaattttttatattgccatgaaaccttcagcatgtttttatatgtaaattaccatagacaggaaaatgcaaatggatctgaatgtattactcttttcaggtttaaacagtggttttaataatattttcaaatacataactatgccatgtttacctcttatctttcccacattgaagacctttacaaatttagatacaaaaataagtaaacactccaacacgtgttactttatcttttggtcaggaattaaccaatataaattcattccaaagaattaagctatttgaatttaatgtgagaaatgaactataattatcagaagtgaaatgtcttaaaggttagaaataacaggaagtgactatcactaataaatccttattttctaaaaataatgtatttcataattttaaagtatttgtattgatatattgttgctatgtggtgtcttcagtaatagggtccttaccaccaagtaatgaagtaggtctatcagatgatctagctggaacactcctgagcatattcccaaaggaatctgtgtccttgtccagaaacttgcacatccatttgcattactgctttattcacaaggcccagaaattagaaacatcttaatatccatcaactaactaatggataaagataacatatatacacaatggactattattgtgacataaagaaaaattaaactatgaaattaacatataaatcgagctagaaatagtcattctgaatgaagtattccagactcagaaagaaaatatttgctctctcatatatgaatgttagatttggatctttagttatgtgcatttgaatgacagtacccattaaagtcataagacatatatgagacaatggtaggtagaattcaaagaaaaatattgtgtatatatatatatatatatacatatatatatatatatatatacacacacacacatataaaacagtttccatagggagatggatgtatctagagagagataatatgtaaaagataaatattaagaggcttacacaaagaagatacaatatgtaaatgtgtatccaaatgaaatgcagacccatactttttttaacaaattgcattacatttcatgtctatatataattgggaacatgatgtaaaagtactttattatgaatgttatttgtcacctttacaattaattttcttaaatccttgcagttttttttccatttaaagtcaaggaaaacaagaggatttttaagatatactttgatttgcatagaactaatggaaatcttctgtgccattatgacaatgagaaaatatttacagactcactaacaaaactaattcaaggtgctgtttccttaacattactaaaggagttaaatatggtaatataagaataaaaaaataaatatctgtgagaaatctttttgtatgtaaataattctttagcaaacatggacatttctctcttctttaagggtctggtgaagatatttctggaaatttattgtaaaataatcttgtgaaatacacaatgagctaagtatctccatccctagatatttatggacagtagtccaggagatatcctccttcatttgcatgattaacaataaaagctattatgataatcttttttaaaaaaaactgtatatgtgaaccttgcaatgcaaaacatggtttgcaagttgcatagctgtgactgatacatctatctcatttctctatgctctttcacatcaaagacatctaaagctagaatgcagagtgatgttcctaagacaggataaatagttcataaggtgattattgttatgtaccaagtgagtactagtgagtctgtacatttctattttacctctttgctggtctagaaaagcctatcttctgcccagaagtatactatttcaaagagatataaaacaagagacaataaagggccatatgtgtatggaagccagagtttctagtggcaaaaatttaggtagtcaaaaagtaaatataatttgtactaagttgcaattaactaatagtttatttatacattcatttaacctaattgttgagagtatctcctgtgtttaccaatcacttacagggagatgagtagatctatgaaatctttaaatttaacaaactatcagtgaaaaaaaattcctgtaataggttgttagccatgtgtcattcggaactggagtgttctgaagggggaaaacagtaagttaggttcttactaatgcatattgaaatgtggacaaactttgccattatgttaagttagaagtccagacataaaatgccaacattctatgatatatccagattaaaaggatccttggaggcatgaagcagattgcttgctacagatgtttagaaggaaaaaaaaaaaaaaaaaaaaaaaaaaaaacggtgaaagcttacaaattagaatgaaatttccttttgaaggaacaagtgtcttatatttagataaatataaactgtgattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcctcctcctcctcctcctcctcttcttcttcttctttcttcttccttcttccttcttcctcctccttctcctcctccttctcttccccctttcttcctcctttcttccccttcctctcctcctcctccctgttttccttctgcttctcattttccttattctcccttttcttttaatttttgaattctcacagctaataaccagaccaaggggcaaatttatgattaaactgccttccatatagttaagttcttttcaaatctgtaataactacttcaatctccacatatttgtgatggatcaaaattatgtgttatatctagaaagatggcttcactatttaaatgtaattgtttacatgcctgttaatatgtgtttgattccttgatcctatgcaaaggttgaaagatagaaatacctccataaagttatcctccgacctacacacacacacacacacacacacacacacacacgtacacatactcataccgtgccatacttatatacacaagaataacgcatatatagagagatacagagacacagagacatagaaaatatgtatatataccacaacaaccatgaaaatctaaaaatactatgtgcctttaaatttatgcaaaatatagtgactttaaaactgaccaatgaaaatgaattttattgtttaaagactctgattaaatctctgattttcttgtacagcatttcataatatgagaaaagattgctaagcattgtagcaatggtattattcctcccccagagaagcaaggagttaacataatataaaattcaaatgtttacaaatgttgttaaagaatacatttaataatcatgttagtggaaatcttgttatagagagacaccaaagtgtacattatcatgaatagagggaattataacaaagtaattgtagttatgtgatgctaatattattgcataaaatgattttaatatgcttcttcagatatccatatacatgcaaaaattttcccacctactctttttgttctgaattcttatctatacttcctgagtagaaatttactgcccttctgcaatgttatcatccttttagaaggaataatttgaaaactcctgataagacatagttcaaaactattccatacttccaagttgcataatgttgaaaaaatttaggagcttatctataaattctgcagatatgtacagaaattgttttcaattttattgatttgtttaatataagtttctaaattttctctgaaattattattagcttgaattgtttatataggattatattgtagaatcttttcctttagaagacaggactcaaaagcaagcactttcagaaaacagtcactttatgaatgtttaagaacatatattaataaatggataagagtaatcatattttattaagaagttccacttattttcttttagttttattagattttaggaaataaaagaattaaaatttgaatttatattaaattatgatttaggaattataattttgaggaaaaaaatcaagctgtgtcttcctgtttttttccattttacagtacaatacaaatataaatgctataaattcagttatacaaagtggatctttttctatttcattcaaagaaaaataagtatatatatttttgaaaatatatacatatatatttattatttaagtaaaagtgtatgagaacatttatgcatgctgtcctaatacaattctttctaaaagagaaatgaataagttaaagatataagttctgctcccattttggtctctagttggttagcagaacatggagaattcattgaccttcatataaatgatgcatgacattaaaaataaaaacaatacatatttatatacctgatacatactgtaaggttatctatatcagaaaagtagattattttctaatactctaatattttcttcaatggtaataatagctgtgtgcttgcactctgacttaaacaactatgttttctttgaatacaagtaagttatgtgtatcagcattatatgaacaataaaagcaccagtcattattcaagttttaacctatactgcagcctttataacagttaaaggcaaaataatacatgataatgattttcccatacattccgtaagagtattttccttgcctatttagcccactctgccaaaaatctggtacccatagcattaatgatgcatgaatgcagccattattttacaaatgtgtaaatttccctcggagagattatatatttattgatgagtcaaaagttgcttactatatgttagctcttctcagcaaaaaaggccaatagtaatgattggatagtatttaaatatgtaggatttaaagtcatttgatgatcaggaaaaaagctagcattaaatattaagagtaatcataaaaattactgctaccacaaggagtctccaattccagatattaccatacaattgcaaatcagctgtcactctacagaaacagggttgaacatcaggaaaagagaaactgtggatatccatcagaagccacattcagaatattaggaatcacttgagcttaagaaaaaggggtaacaccacagagaggggggtccatgttctcttaaaacttcatccattcttgttcagtcaattcagttgtaactaaactagaacaaaacaaaacaaaatgtaaagtcgtacctatttccctattatgcagtagtaacacattgaaaaacctaaaggtatcacatggttgtattttctaatctacctactgatgaaaatgtggaactccacttcaaagtagaaatagaaagaaaacaagattgaaggatatagtgacagtatgatctaacactgaccaatgactcatagtatgacaggcactgttctcatctctattcatttttttaaattttttattagatattttcttcatttacatttcaaatgttatcccaaaagttccctataccctcccccggccctgctcctctaccaactcactcccacttcctggcattcccctgtattggggcatctaaagcttgcaagacctaggggcctctctttcaaatggtggccaactaggttatcttctaatacatatgcagcttagagacacaagctccggggggtactggttagttcatattgttgttccacctatagggttgcagacccctttagatccttgggtactttctctagctcctccattggggggccctgtgatccatccaatagctgactgtaagcattcacttctgtgtttgcaaggccccggcctagtctcacaagagacagctatatcagggtcctttcagcaaaatgttgctagtgtatgcaatggtgtcagcgtttgaagggtgattatgggatggatccccaggtgcagcagtctctagatggtccatcctttcgtctcagctccaaactttgtctttgtaactccttccatgggagttttgttcccaattctaagaaggggcaaagtgtccacctggaggttatcatcctgagtgaggtaacccaatcacaaaagaactcacatgatatgcactcactgataagtggatattagcccagaaacttagaatacccaagatacaattggcaaaacacatgaaactcaagaagaatgaagagtaaagtgtagaaaatattttttattagctaatttctttatttacatttcaaatgttatcatctcctttcctggttttcctcccacctagaaacaccctatcacatccccctgattctatgagggtgttcctccacctactcctacctccccactcttgattcccctatactggagtgtctattgagctgttataggaccaattacctctacttcaattgatggaatacagggccatcctctgctacatatgcagctggagccatgtatactcctttgttgatggcttagtccctgggagttctggggggtctggtagtttgatatcattgttgttcctatgggcttgcaaaccccttcaactccttcagtcccttctctaactcatgtatcagggaccccacactcagtgcaaaggttggctgctaacatctgcctctgtatttgtaagactctggcaaagcctctcagttgacagccatatcaggctcctgtaagcatgcccttcttggcatccacaatagtgtctgggtttggtgactgtatatgggatggatccacagatggggtagtctctgcctttcctttagtctctgctgtatacattatctccatatttgctcctgtgagtattttgttcttctaagaaggactgaagcacccacatattgggtttccttcttattgagcttcatgtggtttgtgaattgtatcttcagtattccggcttctgagctaatatccacttatcagtgagtgcataccatgagtggtattttgtgactgagttacctcactcaggatgatattttcaagttccatccatttgtgtgtgaacttcaggaagccattgtttttaatagctgtgtagtactccattgtgtaaatgtaccacattttctgtatccattcctctgttgagggaaatctgggttctttccagcttctggctattataactaaggcagctatgaacatagtggagcatgtgttcttattaccagttggagcaccttctgggtatatgcccagaggtagtattgctggatcttctggtagtactatgtccacttttctaaggaactgccaaactgatttccagtgtggttgtacaaccttgcaatcccaccagcaatgggggattaaggggttaatatccagaatccacaaagcatttcagaaataaaaggtcatggcaataaaataaataatcagcaaatagactaatgaataggcagttgggtgggtgggggagtgggtgggggagtatgtgggggtcttttgggatagcattggaaatgtaaatgaaataaatacccaattaaaaaagagagagagagagagaaatgatcaataactattttcaaaagttcttaacatccttagtcatcaggaaatgcaaatttaaactactttgacaaaccacaacatggttggctatcatcaacaaatccaacagcaaatgattgcctaagttgtgagaaaagaggaacctttatttacttctggtgaggatgcaaagataaattcagccattacagatatcaatttgaacattcctccaagattaaagctaaaacttccacattagtcacctatttcaccctctggcatgtgcctagagaatgccatattctacaatagaaatacttatacctctgtgggtattgctgctttactcgttgtatcaaaaacaaaataaaaacaaacaaacaaaagacaaaagacataaccaattgaatcagcaaattaatggataatgaaaatatgtacatttttaaatggaatgttattcagctctaaggagtaataatatcacaagatgtggagaaatgagcttagaatatatatttgtctgcattcctcaaagtgtctatgtgttctataaatgtatgttaatatgaaacctgagtattttctctagattgtatgctaatatagttgatcacttttttcttttattggctattttttaaatttacatttcaaatggtatccccattcccagtttcccctccagaaacaccctatcccaacctccctccccctgcttctataagggtgtcctccacccacccactcccacttccctgcccaggcattcagttataccggggtatcgaaccttcacaggactaagggcctctcctcccattgatgaccaactaggacatcctctgctacatatgcaggtgcagccatggtgccctccatgtgtactcttttgttggtgatttagttcctgagagctctggaggtacttattggttcatattgttgttcctcctatggagctgcaaaccccttcagctacttgggtcctttctctaattcctcctttggggatcctgtgctcagtccaatgattggctgcgagcatccacctctgtatgtgtcaggtactggcagagcctctcagaagagagctatatcaggatggcttttccttcagtctctgttctatactttgtctccatttcctcttgtgagtacttaataattacttttctctcaccaaaatttgaaaagaatatattgaaataacatcatatataagataccctccaagaaggctgcaaaatgggtaacttttgcacttgggtataaaatttgagataaaatttcatacatttattttctttcagtattcagttttataagttcccttactgaaacactgggtctacttttcatatgtgtcactaagaaaaattctatatcttgcgtggctctctatttggttccttactattgtattatattattcatttaatgtctcaagtacattttgaaactgacttttttactatgacactgtaaactgactcttttaggttgaaagttttccaacatgaatgaagttcttttctattttgttgaattccatttagttttctttccttcctatcttatcattatctccattacaatagaacaaaactattccaatgtacacattttgttctcacccattgtcaagtcaaactcttggaaataagctacataacattcaaggtggcttctgtgaatctccattccttgagtgctttctgatatagcctgatttcattcactccaggctttatgaacagcatagcttgagactgccattcccaagatctgcaattggtcattcattcttgaaaacaatccaattagtcgggaaaccttgtttctttctttgacaccagtttggtagtttatatgattttcctattgcacattatcttagtgttcaaattgtttacatggatctctttcttccttatttcttggaggctatggacagaaaatgtagtttttcattgtagcaagattcctgaggacacactctttgaatcttttaagatgttggactgttttaataggtcattgtctttattaatgatgttttaaatcaacttataaggtagttattataggtatacagcattgtctatattcaaaaattgtcttaaatattgtaaatttttttgctactcaatagaaaatgaattactaatatttacctatgctctgtccaccatcatgaccaatactacaaagaaatgacattttaatacactatcaatgatcaagttagcaatgagttgttggatacttactgaagaaacaattctttaaccaacacttaaatgtaatacttcactttttttcccactcctaagcatcacattatattgaatatccagacgtacaaatactgagcaaaaatatgacattatagtttatgtcttcttttgttccaaattattcaaagaaaatctttgattatgatttctcctctaaaatactctaaatcttaaacatggtttagaattcaacaagaaaaacaaaacatgagatgtagacttcatttcaccagttctgcaaaatccatcaatgaaatgatgacctttgacacaaccatatccaggttttaacaaaatgtatatgtacatgtaaactcaatgattcatttcagtacttttacccaaatttggttttgtctcacagtcatcaatttttccacctatcaagtctaaaagtgcaataaaagatacatggcattctttgtacccttcctttgcacttcacagatcagttgtaccattctacttctctatttagcttgcctgttttaacataaatctatatttaacatttttgctgtcctaaatttttcttcattcttttcattgttctacataaaagtatatatattaaataaattttcaatttaatcaagacacaatttttgaggaaaatgagtataatgtacaagacttgttttataagacctagtgctatttatatggtaaacagtagacaatcccatgaaataaacgaaggcacctcccaaaacattaaaaaaaatgcgttttttttcttttatttattttccttattttcctaagatgataaacaccttgttggcaccatttactttccattcccaaaagttcacatataaattctgctttgttacaggaattccacatactgtatgaaagtctccatctcactgacagtgggagaaaatgacactggactttgctacaattccaagatgaagtactttgaaaaagctgaacttagcaaaagcaaggaaatttcatgccgagacatagaggactttttattaccaaccagggaacctgaaatcctttggtacaaggtatggattctggaagattttattgcccacaaataatttaatgtgcattttttctagagaaatctggatgaaagattaactaagatatagctcatatcttagagagtactgtagcaagttgtgctcatccttataggcttttatgatattttattttaggtttataagtatttgcctaaatttatgtctatgtaccatgtgcataaagaatccacataggcaattacatccttagggctggtgtaataagtgaatgtgcatggtcacgtgggtattaggaactggacctcagttttctggaagagcagcctatgcttttaattgcctacccatctctgcaatccagtatcattgtaagcttgaaaaactagctgctttgataaataaaatattgcttaatatttgtactgttggtctaccatataaactgttgtttatatttaaatattgcatatatcaccaactctttgacaaatttggaaactaaaatattttgaacaatcatatctgggcttagcattccagcatactccaagacaaaagagaaataatactcattttcttctgtgataaaattgtgtcctaattttaatgggatgttatatgttcaatagtcataatattgcctatattctaatcattttcaaatataaatggcttaataaataacacctgaggaaacaaataattatttagtagtaatttcatcaaaaggaggaaaagccagtccccctgttgctgtcatggcacttatattcattgaccttccaaagattcttgtgtttttaagctcctttatgtcacctaagagcatttatggtcttggatatgctcaaaaagtcaatatggaaactatgaatgtttatatggagcagtttgttcacagattaaaaattatctgctaatgttttctctgtccgatgggttggacactttggaaaatgggacttatattacatagtgtatgcctgttagaatcacaatgcaaacacttataattgattgttactgaattttttaaaatactattaaaatgaaacaagaaacctgaacaagttcaaaaagttttctttgaaattaacaatattcttcccaaagactactttgactctgaataataagcagtggaagttcagaatctcaaaagaagtgttgaaagatttgtcaactcttcccttggttttctgtcctagacagtgtcaaaaatcaggacaatattagctcccctggtttctcttctagaagggatgagtattgttgtttgaattttgataacttaagtgcatctcatttgatgcattctgaagtttacctgtcatcctcagtgaagttttttgagtattatgagactcacattttctaaagccacagagtttctggcatttgtgcgtgaacattctagacttgaagctttgtgctttactaataagttaccttggtagatagatagatagatagatagatagatagatagatagatagatagatgatagatagatagatagatagatagagagatagagagatagagagatagagagatagagagatagagagatagagagagatagagatatataaactttttatgatttgcagtgaacctctcaagtttatctgaaatatgggataaaacgcacatacatagttatcttttaattaaaattaagtcaacctcaattaaattttgatagtttcacattgttcattcagagatgtttccacattgtgatagtcatttaagcaaaaaagcaaaaaaaatcataatagaagtggaaagtacagttgtataacattttcaattgctgtctttagtcaagacttaactttatgccatataaatagtggagattagaaaactaattgtaaagtataatactttaatgcacaattagtgtaactagggctatttctgtaacaaatataaacaaataatagttatactttggtatgaaataactgaaaattatcctctagacataattacctagacacactgacccacatagattatgagttttaaaatgttgatttgccaataaataaaattacctgtctatggtttcaaaaatgttaaagcaattttgtgcattacttttaatactagtctgagaatagggatttttgatttggcaaaaacagaaatctctagagccaataacattacaataaaaagatcataatttggtatgtctattaataatgaaaattcatatttatgggatgtgggaaatgaagatccctcattcactactaatgagagtataatcaagtataactcttatccaaatttttatagatattttttaaaatgttcaaaataaaacttccatataagagaattgcaccactcttgggatagactcaaagaatcctatatactaccacagagatacatatgtatccattcagattgctgcatttttacaacagtaaggaagagtagcaagcatagataccatcaacagataaagggaaaagaaaatgtattatatgtacaaaatagactttggttcaaccataaagaaaacataacttcaagaaaatagatctgaaaagtattatattaaatgaaattatgcagtttcaaaaagaaaaaaagaaatctcatttttacatatgcagattctgtttatgtacatgtaaataagaggttgctagagttaccatagattgtcaaagtaaatagaagaacataataaagaagagttgctgctaagccaactaagtaagtcaaggtaaatgaatgcagatgatatgaaaaaagaggctactgggcacacaagggcacagggagaagagaggagaaggggataaagagtacacaaagaaacaataaaagcaaaccgtgtttggacaaacaccataataaagactaattctttgtgtgctcaaagaaaataaaaaaagaccttgtacataaatgttacctgtttcttcaatggattatggattatatagtgcacataatatgtagaggtttagtgtgtataagtgcaattatattttggtagaatattagagcagaaatgtttagcttagaaaactatttcccactgtttatttaataatgaattttaaatttttgctgtggataccaatatagacaattttacaataatctattatttggttgcttgctttatttatttatttatctattttaaactccagattttattcccctccctgtccacactctgactgttccatatcccataccttcttcctgcccaccttcaatattaggatttccccactgcagcagacctccccattctctggggcctccagtttcttgaggattaggttcatcttctctgactaaacctagacccagcacttctctactgtatatttgttggggacctcatatcagctggtgtatgctgcctggttggttgcccagtatctgagagatctcaggggtccaggttaattgagactgcttgtcctcctacagggttgtcctcttcctcagcttcttccaacttgccctagttcaactacaggggtcaacagcatttaagttttatgttgagtgtgattaacaggtatatgatgttactaaatctagcaagtcactatgtgtctattgcagatgtagcaccattacaagtgaatgtgaccctaaaaataattttaagaggatgttcctcagttgcagattttgaaaaataatataatttagtatgaaatccaaatctttagctcctgtaaaacataaagtataaaatattgttgtacttcaggtgttattgtgtgtgcctatgatctcacaatgaggcaggtcaatcaggacttcaattctaatctaggttacatagcaatttcaagatgagcttgagctacagaagacctttttgttgttgctgttttgatttttggtttggtttggttttgctgtttgtggtttggttttgtttttagaaatgaagccaacattattgctttattggtttaaaataattttactatttacttatcatgtgtactacccaatttgatattgtctgtgtaggaatgtagaacaaaagcatggagaccaagtattgtcttcaaaagagataccttgcttataaaagaagtcaaagaagatgacattggaaactatacctgtgaattaaaatacggaggctttgttgtgagaagaacgactgagttaactgttacaggtaatcagtcttcagtatttcatttgtaagtaaagaaactgtcttttgagaaggtctcagggctttgtattgatgtttttcaacctcagtaatgaaagaagcactcaactaaatgctaagtggattcctataggtgaagtttattcctccttgtcttaaaattatgttgtgctgaaatacatttggaaagttaaatagaatatatgtagggaattatacaaatgttagcttttgaaagtaattgaaataatgagtttatagtttttgaagattgtactttgcagtggagtcatttttagaaacattttctagagtcatgaaatagaatacttgcaatctacccctgtatttctgtcatgctatacactagacaaattatttttctaccgagttattatatagatgacacatatgatctcataggtttaaaataatgtaattgcagatgaaattgtttttaaatgtgagtttttcttttttaaatcacagaattctcatattttgatattgtagaaagtaaccaaaatagccaggtgtgatggcacatgcctttaatcccagcacttgggaggcagaggcaggtggatttctgagttcggggccagcctggtctacaaagtgagttccaggacagccaggactatacagagaaactctgtctcaaaaaaccaaaaagaaagaaagaaagaaaggaaggaagagagagagagagagagagagagagagagagagagagagagagagagagagagagagaaagaaagaaagaaagaaagaaagaaagaaagaaagaaagaaagaaagaaagaaagaaagaaagaagccaaaatactatcagagtactacggattaaaaacagtgtacaattcaccaatctaaaaaccctagttgtattattgtaagttctagaatgtgataaagtactcatgtgcaaaatggtaatgatgaaatttgccttacaagggatttgcaagtatcatgtaaattaaggtaatatgtatacaataaatttgcaatgagaaaatctaaatgaacagcaatttagttatgcaaagaattgtattcatgatcatttttttcatttacaacaatgatcacttttgtaaaaagttcctcttagaagggagaagaaaacccagagcaaaattaaaataggaaattacagatatttgcacattcttattgaaaaatggttttgatgacattttggggtcatatttgtcaaacctttacagaacagcataccattaactacttttatttcataccttcactaatgcttgtaaaatagctttctatatgaaaccaatatatctttgataggtatatgtgtcacataggaatccatctcttttaaatcttgaagtatgatacaatttgactcaaaactacattgtttcacaagacttatttgctgaataacaattattctgacaagggaaaaattcattacttaagatgctctagtaaagtctttgataagtattagatacaataaacaactgatacttgcaaattatgatagacttgaatagtaaacacccattgagtctttggtgtgtattatatgcctatcataaatatgtggatgatttgcaataatttggtttgcagtttgcctgtgtgtcatagatcagtattcagaaaaattcagaggggcacttcatcacttttatttccattcttctcagcagtccaatgaaaaatatgccagtatacacagtaaacactgatttttttctgttcaatttttatcttacaaagtatactgaagtagcttttctaaacattagatatttagaaaaagtaagactatgaatgaaagtgatatattctgaataaaattcatattcatttcttgtcttaacttggaaaatattttttctttctcttgaagcactatgatttataagtactatccgtatgaggtagtttgaaactaaacactgtgttgactgataagaaacttacatacaaacatttggcaaactaagtgtagaactttttactgttaaattgatttgtcattttctatactttcttgatttatataaaacttctcattttcttcgtatagaataaataaagaataagttttgttatccaagaggaagttagtggtttattacaattattaacgcaaattaattatgtaaattaataggtctcactgtgatatttctatgcatgcctgtattatgcattcatcatgaacaaactttcttttatgcaaatctttatctgttatcccttctcatcctcccatagtctgtttcatactttgagatagtttcttcatgggaaagaaagtgtgcagtactctctctgatctttctcttttttccttttaaaggcatttttattagatattttcttcatttatatttcaaatgctatccccaaagcccactataccctccctctgccctgctccccaacccacccactcctgcttcctggccctggcattcccctgtactggggcatatgatctttgcaataccaagggcctctcctcccattgatggccgactaggccatcctctgctacatatgcaactagagtcacagctcattggggtaatgcttcgttcatattgttgttcctcctataggattgcagacccctttagctcctttcttaatgagattttcatttccattcattttcctgcaaatgacatgatttcattcttctttgtggctaattaatactccattatgggtttatctcacccatacatgcttatatacttacctcttgatacgtatctgcttatggagcctgggtggaactatgctaggtccattgactatgttatggttgtgtagcttggtgttcttttacgacccctaacagtgggagcaggggctgtctgactcttttgcctgcttttgggactcttttcctcctaatatgtcacatattctagccataaatataagaggaggtacccagtgttattgcaactggttgtgccaagtttggttgatatttctcggaggccctctccattctgaagtgagatggaggagcaatgaatctgaaggagataggatgtacagggcagggaggagtggagagaggagaaactgttttcagattattgtatgagagaagacatttttaaaatgccaggttaaactcgaatatatgcaggcatttctttctataagatggctttatttcctttggtaacttactcaggagtgggagatctggataaaattataattttgcgatagtatttgctttgttctgtgatgttttagcaatcttcatactgattgctatttagatatcaccctttcctcacattcaagccagtctctctctctctctctctctctctctctctctctctctctctctctctctctctctctctctccctctttctccctcttttattcccccctccaagcacatctatatattctccctttctctctttcaaatttgaggcctctttcttaaaattccttttacaaaaataatatttatttatatgtattcataagtatatgaatatacttatacaaatacaacctcctcaatctatatagtatgatttgtatatatgttttggggctaatcatttggtacttgataactaactttagtgatcttccttgggaaaaaccatttcttactctcagacttccttagctgtctgtagcttttttgtgtagggttatggcccactgtgctttccccattctcattaacatgtctacttttattgcccccttttaaggtcacattttgacaatcatgttcataaaaccttgtgggtatagtttctgaaattcctattcattccccatgaccctgttcctcttgaaccataatccaatataaattctgattccttaagttgttttttgttcatagtatttagtcacaggaacaaaagagtttttaatccaatagtttttctgggtataataatttgattagcagctgtggtatttcaaaacaattggtccctctttctaagctgtatttttttttttttgtcaaattatcatttgtttttctaataggcctgttttataagttaatgacttttttttcttttctcttttctttttatttcatctcttttaatattttagctacaataagtcatggggagtttgttttgttcccctgtctttttggtattctatagatgtcagacttatataggcaactttggtaatgtttttctatatacctaaaaaggttctatgcacctttgctatttggtcttctttctcctctatccccataatttgaaagttaaatctctttaaaatgttcaaaacccttcattttattccatatttttaaaattctcatcaactttcactgagtaataatatttctctattttatcattcatttctgctttttttccaaacatgatcaagctattgatggagtgatcactgaaatttttatttgttttatttaatttttcatcttcactatcattttagttcagcttttctttgacaattctccatttttattaaactgttatggatagatttacacatttctttaagttctttgctcttgttctcttgcagtacatttatatcctctttgagttgtttatgctattattctttgaattcttttttctagaagatattctaggtgtttcacgttgtgcttcattactgttgggctactaatttgtggagcatgctgtcttgttttgtttttgttttaatgttagattcatttctccattgagtcttgttcttctgaaggagtttgtcaggtatgtcttcatttttattccaaacatctccttcaatgtatgtttataccctacagaagagaattaagttctaaggaggttaaaatactgtgtgtgtgtgtgtgtacttatgtaactggtattgagggcagaattttctgtccctagtcttttgagggtttattcttttctatacaaagaaacactaagagttaccacaccctctgttgatcctctctgctaccttttggtatagcattccaagtctagttgtctagtgttgaagaagctctggtcaactgttagcaggaagattagagatctcaagagctagttatgtaactaagagtcctatgaactcagaaggagaaccacctacctgggaatcctggtaagggaaatccctgaagagcaggaagcagtgggcctagtctgaggcatggtagtgagagatcacagagaaactatagcatctgcaaacacttggaggcttgatctggaagttgcagccaggataagtgaggcacaatgatgtttacatactagtcagagaatcagcagagatggactgccaggaatagacagcagtgtaagtaagtaccttacttagtcaaatgagaaaggattgtcttggtgcaggtgagcaggcctatgggataagaagaagcacaccaaattgatggtgactcgggatggatatccaataaaattagagataccaaaaaaagtgagcactctttttaggaagaatacaagtagatgtctacaatacatgcatttgatgactccttagtgatgataagatttaactatatttttatttatagacttccatgttatattggataataatttttctgaactgtaatggcaaggaaaaatgtgaaaatagtcaaatttatattgatataactagacaaatacctatatttaaattccttacactaaactatttttatatttaaaatacaaatttagcactaggcccttttcaaattatttccaaaagtgtggatatggaaaaaatgctatatgtggaaaatgatccgcattaaacctgataatcctgaaataaatgactcttctttgacttttcttaagctttttataggcggaatactttttaatcttgctggtgtatgcacatccatgcatgcatgaacatgtatatgtgtgtgcacatatgcacgcgcacgcgcacacacacacacacacacaccttcctgaatttacaagggagattatcaattcttaatgagtccttaaaaataaatctataaaagcttcaaacctgatgaaaaatgaaagcaggaacaaaaatgaagtcaaaatttatgtgttcaaaccatgtacttgctttctgtacaatttgggagaggctcaaattttaacacaaatataattaccttcatgttccttctcttcattttttcttggtattctactatattttttcaaaatgttataaaagctttatgtgtttttccatattgcagattttaatatagttttatttttttttaaaaatgggaaaattcaaatgttatagaatcaagaagaaaacaagttttatattctattaagacactaagaattccaaaaattttatgatatggtaaaattattcattccctatacacagaatatgttgcctataaaatatacatatagaccactttggtagttagtaaatatttttgaatacaaagagcatactaagatcattgagaagtttgttgtctcccctcaaatattctaattatagcactgattgtctgctttaaagtgttaaatacttaatattttggagattctctcctagttgtatttgacttaggcagagttaacagtttaaaattactgtagtatactatgcagttcacttagaacaaattacagatgtttcctctatttactgaaatggaagaacaaaaacttgatacttttatttacctttgatactatgttggtttttataattatgaaaaatggtcagagtatgaatcaagagaatgaggccatgttgtaaagattcagtagatatttactgataaaagtaactattattctctccaattatccaatataatgcaccccaccccccccccagtgttaagtattcaataaataacttttgagcataccaaccagggaaagggtgagaagagatgggtcctctaagttaaatgtcaagtataactgggattttctaggaaagagtagttaaagatgcaaaccatatcagaataaacaaagagaagacctgccaacaatagacaagacagaaaagcttaatattggaccacattttttttcccgtatagtcagtttactacagaccaagaggcacaggtctggctttcttcattgacattcagacatcctagtttccagtaactcataatggatctgttacccactactcaatacaaacctattcctatttggagactagtttctacgaataccaagttgaatttccttttatttgtactaaaatacttactctcaaatttgaaagggacctcaattattccatgcagtttctcataattctattatttccaaacaaaatcaaaaccctcaacagcacatccacacatctttcagtcactgtgctttctttagttcttattccatgttcagatcgttttttgaagcacaatgaatagtgctgtactgggtttctagctgcagtttggcctctcattgtcttctgcttcaccatgatcttccggttagtctattgtttctcagattgtaagttttatatgtttgataagaagccatttccagatctccttctgtaactttgttttttataactgcctcaaatcttgaagaactgagcacacaccacccttccttactttcatttgttttggtgtcttccaagtttggagtgtgaatggtgttttgattcaatgataaaaatccattttccatccaaattctgtaaaacatttttggtatcacaagtatcctcaaatttaatgtaatcaaatctacttggacaacaggaatacacatcacgtggaaaatatacatcaaatataggacgataatttaaaaggtcactaaattgtcagacctgttattgtctgccaagttcttgaggaactgggaagtgttggtgttggaaggtggcagggcaaaagttgtacagagtgacaaaagcaacattaggggtggctagcattgctaactgatttagcaaagtgcagctccagagttggcccacaaatctgtgtatgtcactctctgtgtttctgtctctgtctttcttggtctctgctctctgttgtggaatttttttttgggaaaatatttacttgttcagagcatggacaggatatttgttttatttgtttggtctaaataaaaataagaaagggccatatgaagttctttcagaattgttgatgtggcaagacttcattatttcaaattaattatttgtatttgttttatattttacctgcatgtgtgtctgtgggatcctggtgcccaatcaggacagcaaagggcattgaatgtcctggaaccacagtagttacagatggttgtgagtcattgagtcagcactgggaaccttaattgagtcttttctcttggctattcagccatctctctagtatcacataacttcattttttattcatatttctggcaaaaaaccatttttaatgattttgtactggaagatgttaaacaaaatgagtaacatctatgtattataaaccttccaaccacttgaaaacaagtaatttctaggtctcaaaaaaacaataagagaatggattaggaattttttttcaaaaacaatttttattagatattttattcatttacatttcaaatgctatcccgaaagtctcctatacccttccccaacctgctctccaacccaccaactcctgcttcatggccctggcattcccctgtactggggcatataatcttcacaagaccaagggcctctcctcccaatgatggccgactaggtcatcctctgctacatatgcaactagagtcacaagctcagggcgtactggttagttcatattgttgttcctcctatagggttgtagaccccttcagctccttgggtactttctctacctccttcattaggggccctgtgttccatccaatagatgactgtgagtatccacttctgtatttgccaggcactggcatagcctcacatgagacagctatatcaagatctgtcaccaaaatcttgctggcatatgcaatagtgtctgggtttggtggctgtttatgaaaatgttctatcttgaaaacaaattcttaactaactatgagacttaagcagattagtcagaaactaagtaaggaaaaacttactggaaaaaaaaaaacaaaaaggaggaaagtggtaaaagaattatcgtttcagtaacatttttatacttgatacaacattttaacagagttaatgtagcaatatatttaaacgactttccaatcaaccatgagctaaatttgtgctttcaaaaggtacatcttcctcctctttttatggatgagaaagctgaggcaaaaaaaggttaagtggctttatcaaggtcacaaagcatcacagtgacaaatgtaggaataaaatttaattccatgaacttcaatctatgatttactcttctagataattaatagtaagacattgtagttttcatattagctctgctgatcacaatgaaagatttataatttaggttcaactgaaacacattgtactgagacctttaattcttctgccactgatgtaattaaatggtatatttctgggtctagctcgaggttaaaggattttttttccctttctctgtctctttttctcaaagtagtatatttttatcttcctgaaaggaaaattgtttttgttgaatacttcaataaatcaaccatgttttattgacttgtaatctcgcatgaattgatgaaaattatagtaagggatattctttaaaacattccttaccatgtttgctaacatgtcagaatcaattttgaaaacaaacatgcaggttgttttggtaaagaaaagcatattgatagctgtcattatttttatataaaaatatatcatatttggttgttcatgtatcatttattgcatgtatcatagcatatgcttgtagtgccaacattcaagggcccaagacaggagcatctcaaattcaatgccagcctatgttagttagaagaaccaagtttaaatttcttcaagatacatttaaactttgtatttaaaaggtacataaactttttgaaatacactatgagtttaaacaaattgactaatcttgatttgaagtttaattcctaaagcaaaaacaacagcaaaacaagaacaataaaacaaaaggcaaaaaataaataaatgaacctacttcttttttttttaagtatataatgatcaccatataaagtgatttacaggcactatcatccatattcttcagcaaggaaaactgttagtctattttggacatgtatttatcatttaaataaataaattgtcattattcctggtaagtgaattctgttatgttacttacttgctataatttctgatgctcctatgcttatggcaacaaacttaggtataagagtagaagagctatccaataaatattcactgagagaaacacatataagatttaaatctgctcaaaacttctactttaaattgtgttatgaaatgtggctagattgaattgtgatgtgttacatagtgtaacacagatactgagatgcaaggtgtatctctttaggattttgaatttttaagtaaatgttcaaatcatgtttgttatgtttgttaagtacagtatattacaaagtgacccaaagaaataagagagatcaaaagtgtctaaaatttcaaattttctttttaatttggaatatctgtttgaatatagtgaactatgggatgtgccccaagtttaatcacaaaattagtttatgaccttgaatacatatcttatgtacatgatctaaagcaaatttcaatttttctagtattttttcttgactttgtttttttcatttatttttgttttgttttgtttcctttaattatccatggataataaacttttcccatacaacataatctgaatacattttctcctccctctacatctcccaggtcctcattacctagtctgccatccagatccacttactttctgcctcttattagaacagaacaggcttataagagataacagcaaaacccaacaaaataaaacaaaagataagataaaacaaaacccatcatatcaaagttggacactataacacagcaggagaaagagtcctaagagcaggtacaagagtcaaagactaagcaactttggaggcagaggcaggtggatttttgagtcgaggccagcctggtctacaaagtgacttccaggacagcaaaggctataacagaaaaaaaaaaaactgttttgaaaacacacacacacacacacacacacacacaagacaataaaatcgatatttatggaccaaagagatggctcagcatttaaaagcattaacagctcccttgaatgtcctgagttcaaatcccaacaactacatggtggctcacaaccatctgtaatgagatctgatgccatcctctgggatgtctgaagacagctacagtgtacttacaaataataagtaaataaatattttaaaagaagagtcagaaacctacatgtttccacagtcgggagttccacaaaaatactaagctaataactatcatacatatggggttgtcctgggaatgacccacacaaaccctgtgcttgatgcttcagtctctgtgatctcatatgtgccttgctctcctggtgtcctgtgtccaagttgggaataactaatgcacaaatagtacaaatctatgaataaagccttttatgtatcattgtttaatgcacacaagtgtatgtgtgtgaagtattttccatatatctttattttatgtagctaagtaaaaagtgaagtacagtgtgtataaacaggataaatggtgaatgtatgcatttctacatttcatgtgattataaatatgtatacctatgcatgtttatctacaaatatgcatatatatcactatataactgaacttatattgtttttatttttaagatttaatttttatatttttatttaagtaatttttgtctttttgagtaaggaatatataagtactgtgtttatttcatttagactctccttttttatgaccccattccctctcaatctcatgaacttttactctgacaccttctgagtccatttaatgtttctcgcttgtatatgtgtttaaggatgaccacttgggtttggagaagactacatctctgttcctcaaaaccatcaattacctatagctcttcatctctcagtgggaatctatattttattggtttgttatagttgtaagctgctcgcggcctacaagaatcgggtactcctgtaaagcaggctggggctgaaaaagatacttagactgtgaaagaatgaagccaagacaaattttctctgatcaaggcctgcaagtttactaagagactgtgcttataaagggggaaggcccatcccccaccaatccattcttggtgcctgttgcagcctgaagtgcgcaacatggattgtctcaaaggtgtctcagcaggcagcaggatcttggagaagagcagggcagttgacacatcaaaagaagccagccaagtcagaaagctgcaccgcaggtggccccacctcagtggccacaaggtctgcaccagcccacttcaggctaggggaagctagtttgtcaacatcacttccttacttccagtaatgcactgtaaaattcaatatgctatgattctattctttaccctataaatcaatgatctatttacatgtgtttatatttaagccaaatcagagacaagaaatagaatagaggttacagtgcttgtgaggtacagtaatggggagttattgtttaatgggcacaagcgtctcaatttaggatgaataattttaaaaaaaatctagaaatggatgtactgatagttattgtaaatatacttcataacaataaattttatgcttaagatgggtagaaattatgagtgttaggtctcatacttttcactataaaaacaatttgaaaatgtgtattcttcacaatgtaattttcatttcaaagatgttttatatgactctcttttccaccacttcatgttgtctctgcaatttgacatgtaatgatttttctagaacactttgaagctcccgcttttatgtcagcactttctattaagtgcttttagttttcacatcagcaaaactagctttgagcgcaacattgctcctatttcaattcagaaactggtgtggaaggtttcacaggacaagttaaaggaaacctccaaccaatatgttgaattttctcagtctcattaaatcagaaattgaaaatacactctgggacaattcatttctggtgaggaataggtgattatgcatctaaaattaaagctttaaagatgaaaaagcaacataatagaattccaaatctcaaaagattaaaagactgcaacatatttatgacacttaaatctgaatattgtcaataaaagtggtaacttcaaggctccaacatagttagtaatttattctgtgctgaccctataaaacttaacagtataaaatgtcaatatgtgttaatgagtcaaatacatttcataataatttgctaaattaattttaatgtaatgatacatatacatacataccacaatttattttcttagagaattataaatccaattcaattcaaacctattactaattttattattaccactgagtaggctaagcagatgtaagtgcttgccttcctgactgacaatcagagttaaatccctgagacccactctctcatatgccctatacattnnnnnnnnnnnnnnnnnnnnttatttcttaaaatagcttttttgaaattataattacttcattttcctcctcttttttcttccctccaacccctccctccacctctctctctcctctctctctcacacacactctctctctcaagttcattttctcttattttttaattattgttgcataaatatataaattcaacttgttcagtccatataatgttatttgtatggatgattttagaaatgactagttgatattatataaccaattgtgcttttcagcacacacacacacacacacacacacacacacacacacacactgtggtagagaagactatttctcccatccactatcattgcttagttacctgtagatctttgtctaggattgagtccttctaagctttatcccttctgcactagcaatgtctatttgtgtcttccttttttctgtcttctttaggtaaccatatagatgagtgtaccttttctacaaattctaggagacacaatctcacaacaaactttctgtgtcttcagcaatatcactgggtcttaggttctggagtcaggttgaagatgtatcagttgagagtaagctacacaaatatgtattttaaatagttgtggttttctgtaatattctccttctagtggaaaaaaacacttttcttgatgaggcataagagctacatttatctgtgcctataaagataactatttagaaagtagttaaggattatgatggatattttcaaaatattatatgcttttactgttacccttgttgcatcccacaggtagaagtaagtctctattgcttagaatattatgcacttcagaaatagggtggagaggacctaatttggccataatctgaaagtctgagaactagttttcatgatataataaggtaccatgcaagtttcccaaggagagaagcaaataatagtcctgtttagcaaatatgcctgtgaactataataacacgaatcaacatgggtaataatcctaagttgtagtagtggtatgcatgctctggtgacaaaacaaagacaaacaaacgaacaaaaaacagctctatgattggagttaatttctttcaacaagaaagaaattatttctactactagaaacatagccaatactccagggatagtggatctggaaagaaaacctatggctgccaccatattaaaccaaaacttatataagtataataaaaataatacaaaaacttccagatatttgtgtcttggaataaataagactaagataatttgtgtgtgcaggcatactgtcttgaaactgatgacattatagcatctcaaatttagtttgagtaaattcttattgtgtttcaaaatgagcaacaattcacaaaatcagcaactgaattgttgcccaatcattctgataattatattcctgtattatggagttagtaacaaacagatctctcacatcttcatttaataatcatttgtggataacaataaacaggactcagtttgggaacagatttctaatgctgtcttctttagaagttttaaacataggaaataatcctatgtgagacaatttagggatccagtgatttttttcagttatataaaaaaaattgctaagctcttacatcttgtataatttaagaagctctaaatgactatgaacatatagatattgatttttgttgtgagaagttcataacaaagtgtttaaataataatgtttgttctaaaattttaagagtttaaaagctttataattttgtgttctatgggaaagacagaaaatatattccaagatttcacctgtctcttccatggtatcaaatgtgctgttgttgaaaaaaaaaaaggaacaaacaagtgttcatgcttaattttcaactaatatgaatattttataatatattttagatgaatttgttaagttgcctgaaaatagacattttgctcttcatgtaaaaatatatgacttttgcatcataagagtatttcatattttcatttctcaaaatgcttgaccaaggcttttagtcattatattagcatctgttgttccatctggcgaacctaaaaaagccaatgtattctaaatggatagttcaacatgaatatgcaaattaatgatatttcatgacttctgtacaaaatgtaaagaagttgcttcttctatgccttaagtagaagaccttaattttatatacatacatatatattttttcctcatcatctgttgggttgaacattgggttccatttcagcaaatccgacagaactttctgtaatataaatggcatcaaagattcataggaatgtcatatgccttgtctgaaataatctagtgcaatatattttccatgaaaagaaaacacacacactcctacaagatactatctaaaaatacaaaagtactatatgtagccatagatatgttctagtgtcaacaatagatattctagaacctttaatgtgtacttagtgttagtaatgccatgattacatactattattatttgcttcataattaatcattgaagtatactataaacacaaatactatttctattatttgcattcaaatctcatcatgtataatgtgtacatatatatttttgtcctaagaacatcagttatggttacaaagaacaatataaacctttattttaaatatgttttgtaaaattaaacatgcaatagaaacatagaaacttctgtcttttgataaaaataaaactatctgaataattatggaaaagtatggcagttaggtatgtgcaatatgtattatatagtttgataagtaccttctcaaaatattacctgaaaatagagcgtctgtaacttgattttattttatactgtaaacaatgtgtaatggtataattttttagagtactaaaggcactaataattgttaacatcaaacataagcaggcataaagtataaaagatgtgaattatatctattaatgttaaaattatatcctataatgtagcaactaggtagagagttatttactcttcagtggttgattatgacattgctaaaattctattaaaacaataggctgaagacaaatataatgcaatatttcagataatcttttccttttgggtgcataatcagatcattttatgttaatgtagtttatcttttaattaaataaaccaattgtgttgacttgtcttttcatatgttgtttgcctttgggcatgatcatttgatcaatatttgtaagaaatagaattatcatgacagcaaacatttttgcatacacaagcaacttataatatctaattatttaaatgagtgcttcttaatcttactcttagggagaatccacacttgttctttttaatggaattaatacgcaatagctgatttggggactgatgtcattcaaattataaattttaaatagtgaagtgaatatttactccaggaagattgagaagccctttggcagacaaaagcagaaataatgacaagacctctatgaaaaaggtagcttgcttcacagtaatacttgtagcagttagtcatttattaatcaagatgaatctttaaaataaagatgccaaatagattttctattggaattcgagatagtttttgtagatgtgtttctgtattttgtaataattcttattgtgtaattgagagaaaatatagtccagtttctgtaatatgaatgttactcagaagcagttactcttcttcaagtgtttcctaattgcctgcttacttcaaagtagaatcatatgactaattatcatccatgaatatgaggcaaaaagtgaagtctgagacaaagcagggaagaatcatttatgttcacccctctccatcctcctctagtttttcaatccagagcacagaagaccctaactagtggaaggactaacatctcaacaacagaaagcaggtcactgacttggaggattctcactttgtggcctccttagtaaagaataaccttatgatttatcaaactattgagattgttgggcttacctctagcagatagccttattctaaccacaataagtaagccttaccaatacataggcataggacagaattgtcttgttacaaaagatctaatacaaattattcatttgtttagctgccatcttccaatcctgatactcttcttgtggtatctcctactcatacattaagtatctccatgttcagactccccctggctttcaagggctagattataatatatagcccatctagttagctaccagacctgcatagctctagacagccagttctccacataaatcagttctgttttacaccctctgtctccatggctatttcaacactttccattcttcaaagttggcctctaaattactgaagacaagatctgacttgtttagtttggtgttattaataagtatattttgcattattgaacatatagtagaaagatgaataataatcaccatttgaaatattggatgcacttaaagctgaattgggtgttttaagactatattccactgtaagtaccataaccaaatatatttaatcttaattataacctacataaataatcacttaatggtcctatgtttattcataaaataattctaaaatgtaacttctttatttcaaagtatttgcatattcattgttataaaattaatattattaaatacaaattaattacaacagttttctttacaattttttatgatatgaaaataattcttttaggttagaaaataatattcatttaggttatcacaagctatcttccttttataaggcaattgatgtattttatatatgcacatttgtgacagtttattcagcagacacagaaaaatattttaagttttaaagtctcaaaagtaccttcaatttggaaaaacaactattggaagactaatactaagagaacacacataagataactaagagccattagggaaaatgcatatacatcaaagttcaaaggggaatgaaaggccattaatgagaataattaccagtctttttgaggaagggctgctatgtgctgatctgacattggcatcatattgtcctttcttgttctgtagtattatttgcaataaaatgatactaaaagaattcaaatgcctttgaataaataacactgaatagaaaagagaccatgcttgagactcttgttgtttcaggtaatttgtaattaagattataccttcttgagaaaatatctgatatggaatttcttgaacagatcaagcatcctaatctgaaaacatggacacacacttacaaagtttaacactcttctttttaatgagttctaaatggcagaaatccttcagtgttgatagtacaacaaattattcttgaaaaatcaaacttcctgttagtaagtcttgatctacatgttcaataaatgtcttgggaatctagttttgttttgttttttcctttcaacatagtgccatggacaaataaacttttcagcatcccattcatgtatagaaaattgtgatgagagttagttaggcacttatatagtagactatgaatgctggtctccccttcgggtgaataaaatgacaggaaaattgcaacaacaggtaatctctacatctgttctggtgtcaagggactgatacaacgtatatttgtcagagtcatttttttattggtgtgattcaaaccatggtaataaaattattgttaaaaactttccatgagttccggagagatggttcgggggttaaaagcactgactgctcttccagaggtcatgaattcaattgccagcaaccacatggtggctcacatccatctgtaatgggatcttctagtgtgtcttaagagagcaacactacttatatagataaacaaatctttgaaagaaaaattttccatgagaaataaaataatttgattaatattccctgcttagtttgagccatgaatacgatttgaatttgctatcctttagtgagtgaacattattttaatgcaggtaaaatgaaaaaaaaagtttgatacctatatttcttgcatgaactagtgtgtacatcacaataagcatgttgcatatagcatccaatttaaactggataatgcatggcctatcttataataccctatgttggcagcattttaccagagacttttttgataaatgctgtatctgtgctccaccaagctcttatttttattctgtgttatctctgtgagaccttctagggaaaatgtctcctagccccccaaatatgaattatattaaaataaaatataaaatgagaaagtaagtgatgtatgagaaatgattataaaagatcctgggagttatgtgttgggaattagaaagtttcccacagaaatagatttaaaattgctttacaaggagaggtagattttgtactaacggtttcaaattgtgtgtgtgtgtgtgtgtgtgtgtgtgtgtgtgtgtgtgtgtgtgtctgtgtgtctgtgtttagaggagtaaagattttataaagacagtctatttgagtggattattgtatacaaggggagaccattgggataagtgactataacatatacaaatctcttaacactcaggcaacagcttcttgtttcatagggagagaaaactaagctagaaagcttcaggactgggatcacaaggagagaaacagaattaataatattcctagagaatactaacgctgaagttagcctacaatttggacaggccactcagaaacacctgtgaggagcacaatctctttatttaatctggtagcaattttttcatcctggatggaattagcctgaacttcacacatgcttaacacgcagtctgttacagaacaatgcatttagcctgtcttttacgttttacaaatttatttattttgggctctattttgacatcatattcctctatatagccataactgttccaaaactcactatctataacaggataacatcaaaatgacaaggatctgtctaattttgtcactagggtgctggaaataaacttgtacaccaccacacctgtgattgtgagtcagcctcactaagttgtcctgactagaattgagctcactctgtagactggacaagtaatacacttggggtctttcttcttaaggctctattacagactataaagcaannnnnnnnnnnnnnnnnnnnnnnnnnnnnnnnnnnnnnnnnnnnnnnnnnnaagaatagaatctttaggtaatcttaaacattgctgaagtcatagaagaagtcagaagagcttctgtgattttgagttgatcaatgtggataagagttcaatttattttagaagcaaaaacttggaaatttgaaagagtttttatgtgatataggtaaagtcaagcacatatatcttgagtaagttagatgaacaaccctggttctatatacaaaacacaaaagggagtgatttccttgctttcaccatgtttgaggatcacagggtttagaaaaaaaatcgaccttttctggggtgtgggataatgtctataatgattgataatgaatgagatgcccatatggtcatgacttatatgctcatagcttgaatttggatattgcaaaggagtatactaataaatagcaatagtatcctgtttttttatttttgaatgccaagtacatatataagtatgttatattatcagctcattttaaatttttcatcagtcattcaataatgccatataatctcattacttccattttaaagacaagaatctcagagattaaggcccttgaccaaactgatagtgaggagtaaaattggagcttctaatcatgaaacctagcagctggtctggcttcttttcataatctcagaccattttcttgttttctaaaatgcagatgaaacaaaactgatttaataaaggagagtaatcatgcaacattttctacctccaaaatcaatggagtccaacaagtactcgagttcaacaagtactcttgagagaagtgaaaaaaatatagaaaatagaaaagctggatatcgatgtttatgtgtagcatgtgtgtgtgtatagtcacagttgatggagacataagagtgtagctgataagaagaaagattcttgagttagaaaataaataaaaacccaaaaaaaaaacccaataacaaacatagccagtagtgacagaaatcccactgtttttatttttttcctatgaaagaggatgaagtaaagatgagggtcaatcttaatggccctttgatattttggtaactgccatttcttagttttatttagcagcaagcatgactatgttcagtcttctagatagaggtggaaaatatatggcaaatgagctcattttgagtatctgagctaccttgatgatatccccactagtgcagtttattcttcaaatgtagaagaaggctactatttaatccagatgatatgtaattcccttcctcctttactcatttatacttgcttgtacgcatcctgccttgaaatacatatttctactaattatcttacaatataatgcaattacaattctaatgagcccagaaatgtacactctatagttgtaagatacattataacatttttgattatttgacatgtcaaaaataagtgagtcacacgtaattccaaaccttagtttgtatagaaatgcagattgctctaactactgagcagtgaacatttactgagccattctatgcctctatatgaatagtggggacattctcagtcttcctattatttgaacaatcaaattaaaattctgatgcattaatcactttacctcagtacttttatgtgactctttggagccaagttttgaactcagatcaatctgatccatgtaattcactgttaattactcatgtttttcaagactacaggatagcatctctgctattaaataggataaagttaaatacattacttaaacattcttacttcatttgaaatgctaaccgtcaatcttcctctcataaaaatttccaagattaaaaattaatatgcataaactatttaaaagcatatatagctaatatttaatatttattaaacttgatagttgatggttttgaagacaataacatcatattcttttttatctagaaaatagacaaacacaaaatgttatgattttatatagtaacataattatgagaaataaagactatatatttattaatagatgagttcacattactttttatcatgaattttgaaatattttttgtgcctgtcattaaacttcttaggatttctaaaataaaattttatgttatttaagggtacaaaatggaagtttttcactaatatttttggatattttaaggatctgattattctattgatacagtgtataaagagtattataatattcagatgtagttttctcctatctcaatgatgcaaatatgcatgttaacattgctttgaacttcttgctcactatcatggttggattctgtgaaatctaagctaagtatgacttgtcttgtaccagatatctataatgagatatgtgtactataagcagggatcaaaagccaaaaatgaaatctagaagaaagaccaacatataaaattaaggatacattccattgccattaactaaagagaacacagaagcaagaattttctgcaatggcaaacattcacagattcaaagtatgttaaagtaaaatttattttaaagcagcaaggttgatcttcagatgacagtggtaatgtttgtttagttaaaaaatataacctacttttatttgaatttgtgatcattttatgctctggaaagcatgtgatttatagataaagtactctagtcccaaaaatttgtgataggtaattcacagggtattatgaaaatatattgaaactgctcttaaatgcatcacatgcattattaagttatgttaaaatggtagtaccaccatatatttaaatttttaatgtacttatttgcttgtttatttgtgcataagtatgtggagtggatatgcatgtaataaggcaaacatgtggagatcatatgacaacttgtgggagttcagtgtctctttttagcatgtaggtagtagaactcagattccagtcattcaaatggtgtcagcatctttattttatgtatatcagtgttttagtttcatgtatgtctgtgcatagtatgaatgcctggtaactaaacaagccagaagaggacataagatcccctggaaagggagttacagtggtagtaagctaccatgtgtgttctgagatttgaatttgggtcctgaagatcttgataaaattcagattctgattcatgatgatgattgtttccagatgaaagacagaatatagatccatatactcaggtattcctttggacccatctatagttaagtcttaactagtgcttagttaagttttactgggttacttaaatgaacaatataataatggtagtataaaaattgctttaaaattcaggcagtactttgcctaactgtttaagaagatatttctttgtttagctctgagccccatttggaatgtaaatgaagaaaatacctaattaaaaaaaaattaaaaagagaagatatttcttagtttcctagcctatttatgttgcttggtattttctctttctttcatcttgcttcaatgttcctggatatctggaattccttccgttagtctttccctaattatccatccctttcataccctgtaaacatttacaatagaggcatttaaaaatatgatctataggagaaaaatgatgaaaaactgaccctattttcagttatcagtgaataaatttcttctttctctatatctggactctattagagtatgtgttaaatttctagactctcctatagttttatcattctcagaattgagtattctcagtaagtagaggaatttcatatcagtcattttttaatacttgagacttgaatatgtttaatatatgtacaaaacatctttcaccaaataatagtccacttattttttcttcctactctttacttttcttcccttccactcttgatctgttctctctcttgcttatttatttttattcttgaaacaaggtcttaccatgtagtcaagactgatcctatgacatccttttgcttttcctacactttgcagtgtcagaattataggttggtacatttaatattatgttaaatactcaatatatttctgattataccacagaaaaaagtgtttgcacaatgaaatataaccttctattattaaaatcaagaggattgtattactggtacacacagatttttattcaaaccccagttatatatttttctgaaaatctaatgtattaatttaatatccacatcacatatgtgaatatagatcagatgtgtgtatatagagacacatgtggatgtaagttttaaaaggggtatcaaaagaggaaatttgatagaatacatttatctgttaagatcatgttaaacatattattatttttatagaaatgcatcatcatctaaataccaagagactagaactatcatatttgtgtgtgaattctagtaaattaaaaatctacatgatccatgtttctaattatctgacagtgtttattgttaataaaaaagccacaaatacagcaatagcacttaattataaagcagtctgtaatacagcacagtgtaatctttctactgccttgaagatcagattggcagcagagcttgccataatgaactgtcatgaagattcagagtactgttttcagtaattttcatttgcatattcagattttatgatgtatgaagcctgaatcaaatattctcaccacagtaagttttatttcaaagtttttacacttccccttttgtctgaaaaacatgttcataccctacaacttatttttagatgaaattagcctcaaatttattatcttgtattaacatctcaattaataaggttatggatacacactactccatcaggcatagatcttacataaaatggcctaaactattttgcttaaagttttaatggaatattttgctgtgctgtatattgaaaagtatggggacttttacaactcatttttgtttctttcatacacagtgagaactgtcttttgaagttgttatagaatattagccacagagtaataacaaaagacttaatttagcaaattataggacagcttcagtaaatcataagagaaatatcttaataaaatatttccaaatcaaatccaagaacattacaaaagatcatgattgtgtgaaataatattattctaagaaaaatactatatttccattaagtacttttttgaagaggctagacagatggatcagcaattgggaggagcagagtttgattcccagcacctacattaagcagttcccatagagtaattcaagatccaggggattcaataccctcttctggagtccatgagcacctgaacttttatccaaaatatgtagggatggttcaatatttacccttaaacatttttaagaatcttaaacatggcttcttttgtatgttattgtgatttagtagcataacagacaaatattttcatattaatattgatatttttcatgttttatagtctgcttaactactttcctgtgacatatactatttttcttttttacttaaatgctattataactctaatataatttaacatttgtacattttgtgtgttttatttgttgataatctctcaatgggtaattttgagattaagcagcaggcctatccacttaatgaatatttattaaaagttagaattttccttccaacctgagtatcagtgcacatgcttttgtacaaaacataggacattattaatttgtttaatcatagacatattaataggaacaaagtgaattcctatcattattttgtttattatttcataaatatctggttgcttttcaataaaggaatttggctatttgcatattttaaaaggacttatatgactttgtaaattttaatcacttttcaactatttaaattttaattgcccaaaatataatcatcatgcaaaataattaatatgttgcactctggcacatttgaaaatggtaggatagtatgatgattcactttgcaaattattttttcttcctatgactctcagcataaatccaggttataagtatagtaatacatgaaaattatgtaagtggtgtacctaatgaaaatatatatgatttattggaatttattggaattggcattttagaaaaagtatttaaataatttcaggttttccctttttatagataaactgattctcctacataaaaaaattttgatcttctagtctttacttttcatgcgcatatatatatatgcacacacatatatatgtgtgtgtgtgtttaaagatttatttattttatatatgtgagtacactgttgctgccttcacacacaccagaagagggcatcagaacccattatagatgattgtgtgctatcatgtggttaatgggaattgtactgaggacctctggaaaagcagtcagtgttcttaactgctcagtcatctctccagcccatatgcttatatttaaactgttttagtcttcttctctttccaattagttcaacccaatcacattttaactgatactgctaattctttttggtccttctctctcttcgaaaatgtagaaaaatattgtgtttccaagaaaaatattatgtttccattaagtagttttgttttgttttgttttgttttaaagtggctagaaagatggatcagcagttaggaggagcagtttggttcccagcacccacattaggcagttcccatagagtaattctagctccaggggaatccaataccctcttccggacaacatgagcacgtgaacttatgcgtgtgtgcacacacatacacacacacacacacacacacacacacacacacacatatacacacttaagaaatatataaatattttattttcaaaagtagtttctaaaatgcagatcataaagcagatatggttgtaggtcaccaaagagaatgtggagggggaaaaaaaaaaacgtgttcatatagaagagaaatattttcataaaagcttaaaaatcaaagagatagcaaagaggatcagaatacagactagtaatatgtgcgttgctctacttcagtcaggttcattcaaagtgtatttcagggtttgaagtgtgaaataatcctctttttctcagttgaaacttccattatatcatgtgtggttcactttctcaaatttcttcacagagtattagagtatttactgatcattttaatgctctatcaatataaataccttttcctaatagtttggatgtaatagagattgacaattatatgttgtattttctgggtattttgttttgttttctgttttgtggttgttggtttgttttttgttttttgttgttgttgttgttttagaaactgatttcattgtccagcattgaatcaacccttaatttacctttaaaatattcattattatttcaacttatacattagatttgcaaataaaattgttttaaaaatgtcatatagagtacttataacatgaagtttgtaattataacaagttgtaaaatttggtgaaatttattatatccataataatgtataaccatgcccaggatagtttcattaagtaaaaaagaaatcttaaaagatctccattcccaattacatttctcaattttttggcaacaagtagtctaatattagttttgactcctctggacatttcacatgagtacaatgatacaatctgtggtcctcagtagtagattctttcatcactcaatattcaatgtcctttctaacctgtagtatgtttaagggctctattactttccattactaagtaatattctttttaagttgtatgtacccccttttgatttatctattcagcacatgaaaatattagttatttctattgggggttacaaataatgctactataaacatttgcttaccattttacataaactatttttaatttactcaagtatatacttagtatatttactatagcaataagacctttatattttcttgagtaaatgtatgcatattttccacagcagaggtactatttcacattcaaacattaccatttgtttatacaatataaaaatttggttccccacatcatcaccaaaactgctgttttattagttattattgttgtagccaacctatgagcataaagcagtatttcattctgttatcatacatttgcttttaaattctctacatctgtacttttatgaatgctattttatataaaaattaaacacttatgatatagtattttgtgttgttatacaatacaagaaaagatatttttgtagtgaatttttgaaagaaaactattaacaaacatagaaatctgatctaagtcactgttttgttttgttttgttttgtttttctggtttgttttgtatttttattacttattcactttacatcctactcactgcccttctcctgggcactcctcccaaaatccttccccctcccccatctccttctcctctcaggggatggggcatttcaagtctctaagaggctaggaacttcctctctaagaacaaacaagactgctgcactagaagaacataacccacatacaggcaagagcttttgagatatctcctgatacaattgtttggtacccacatgaagacgaagctgcacatctgctgcatatgtgccaagaggcctaggtacagcctgtgtnnnnnnnnnnnnnnnnnnnnttgactgtgggtgtcttcactcatctgagtcaactactggatggagcttctcagagaacagctctgatatgttcctgtctgcaagtataacaaggtatcataatagtgtcatggattggtacttgcccttgagatgggcctcaagttggaccagttatagtttggccattccctcagaccttgtcctatcctacgcctgcatttcttttagacaggataaatttggggttcagagttttgtgagttggttagtgtccatattgtttcactggggttcctgcctggctacagtaggtcgccccctcagtttccatattcccagtgttgtgagtcacagataaggacacccccattgattcttgggcacctcctttatctcaggtgcctgtcttatcctaaagatgccccctagttctgtgtccaggtcaattgaagatttccatccattctcatgattatctggacatctctcctgtccctcccgctacctgattctgaacccatctatttgcctccccatcccctctccctccaagttccctcccattatctgcctcttatgagtattttatccccctacaaagtgagattcaagtttctccacttgggctttccttcttgtttagcttctttgggtctgtggagtgtagcatgggtattctgtattttttatggctaataactacttatgggtacataccatgcatgtccttttgggtctggattaccttcattcaattacaattcatgatgtctttgtttgttttttagttttgtttttgaaaatgtttattagatattttctttacatttcaaatgttatcacctttcccctcctccctctttgtttttaatagctgaatagtatccattgtgtagatatactacattttctttatccattctttagttgacagatatctaggttatttccagtttctggttattatggataaagctgctgtgacatagttaagcaagtgtttctgtgagttagtgcagcatcttttgtatatatgcccaggagttgcacagctgggtcttgaggtaagtcattgtttatggcagaatatctcaacttctgatgccctatctttgttacatttaaaaatgtagttttgaaataattgttctcatagatttatatgcaaatggaaaggaaattcaaatttttcaagtctaaatctaaaatgctcaggaaagggaaaacattaatgcttatttatgagctttattgacctgaacttccattaggggaaatatgtaatttctcattgaagatacatttatataatattttgtttccggtaacataagcacatgtagaaattccatgaaattcactacactcattttcattaaattaaatgtatcttcatgaaacctttatgccttggactggactcagttggtccctcaacctgcagggtatcagggtcccggtattcaggtaggcaaggagcctgtggcttgacaaacagacactgacacagagagagtgctgtatctgaatgtaatttctcaaagcaagcatgagattatagaacagaagagaataaggaagttaggtgacacattagccaaggtacattgaggttaccagatgcttaataactctttacacaaaacagaggaatgtatacataaacactggcaggaactatgcaatgtaacaactgagacaaagtcagctctatctaaggtcagctatattcttagaagccaggtatgaggtccttccactcccagggcaagggctttcatttctaagacacagttcttactagggagttttgctctagctaaccttctcatgaataatgcaatactctagttcctccttaaaccatagcctgatcaacctcctaaaccactgtaaattcccatatatggaagtgactcagctgttattctaagtgattgtgtgggggactctcttctattaagtaatgtagtctgccatgcataaacataataagaattctaaacttactttgctaagcttgccctgagatttctactctatgtagtagatagtaatgcctgatttctttcactatctctcctacaatactagaggtaattctgattgttactgaataggtaacattctttttttttctttttttttttttttttttttgctctttagtcaatatttaatagattttttttattacttacttttctcattctttttttttaatattttttattacatattttcctcaattacatttccaatgctatcccaaaagtcccccataccccataccctcccccccacttccctacccacccattcccattttttggccctggcattcccctgtactggggcatataaagtttgcatgtccaatgggcctctctttccagtgatggccgactaggccaacttttgctacatatgcagctagagtaaagagctccggggtactggttagttcataatgttgtttcacctatagggttgcagatccctttagctccttgggtactttctctagctcctccattgggagctctatgatccatccactagctgactgtgagcatccacttctgtgtttgctaggcctcggcatagtctcacaagagacagctacatctgggtcctttcagcaaaatcttgctagtgtatgcaatggtgtcaaggactgcctacaacattggtgaaggccagtaagcaaagtttaattttgcttaggtatttgacaaatcattgcttggaggtacctataataaaacaatactgaaagaaagcacacagatccattcaccaactaatgcagggacaggtttggagcattcgtgctgcaagatacaaaaagttccaggagactgagtttccctgaaacttcttgccttgggactgcgtccaagcttttgggctttttgagcagtcttcactggagtgagtgtagcaccttcaccaacctggaagaaaaagaattaaaaaaaaagtgaaattaattaaaacaatatacactaatgaggagaaggaagattacatgaaatgatattatagattttgcttatattatatgatcacttttaaaatgttgagctttactagaaattttcttaggaattctcctactggtatattttgcagatttttcaatggcatctctgctttcacttagtagaaacttgctgctctagttgtcaagtatttagccaagaatttggccaaatcagtatttgccaaagttttaaggattctggaaaatacaaacggtcataactatgtcataatagttcccataatcactttcctctttttttatttgtccaagagacagaagtctgaccttgatggcaagagaatctctgctacttttagactgactgagaaaagccaccttctcagatgacctaacttttcttagttctaaaaacaatgacaattaaaactctttgaaaataaaatttaaatatttcagaataaagttaaagcactgaattaatgagatctaaaagtaggaagcatagagattattctgcgaggtcccaagaaagattcaaaatgtacactatattaacatacatattatttaaaattatgtagtttgtactttgcttgatactcagttattttcagggcattgaagtgtgttataaaaacctagaaatatttatctggcactgtctttgttttatttttccatgttactgtggtaaaatgacttgacaaaagcaacttaaaggaggaaagtttgatttcagctctcaatcccagattataatccattatatcagggaatttacagcagcccaagttcaagacagtaatcaagaagcaaaaatggatgagctaacacatgctgcatgcatgataatgcacaacgcactttctcacttttacgtcattcacaatctcatgcctggtcatctctcacagaaacatgcataggcctgagctagagaaactcacaattgaaactcgtttccacagtgattctaatttgtctcaagttatcagttaaaactagttatcacaactatgtttcagaaaagcaaaataaaaccacaataaattttttactgtttggttatattattctacaaataatgcttgaatgtaattgttttatgatgtgtcaagttatgagatttgaatctgtaatccctgaagattttagccctggatagagcagatcattttcataataggtgttgttggacagtttggacatagaatgttgttatacttattccttttcccatatttaccaatactgttcaaatttccattaaaaagtcaaataacagaacttaagtaacctttgtagaagttcattaagtaggctacaataataatgttatataacaaaaatcacagagactgtgataacagtcacttatttgatagtgaaaggtctaagatttgatttccttttaaatgacctggatggtgtttgtcagtgttttacaggtttttttattacttgtctttgattagattaaaatccgttttgatatattaattatttttcacatccatggtgaaagacttagctccaaaagagagggcaaagtgtgggaatggctctaaaatatactgtgtagtttccactcaagtcaaaagcttaatctctggatgtagtatattcttcctgttccaatatgaggcacttgaaaatacatcttaataacaaagaatttatgtagtgtgcacaaaagctgagtttcaatcttcagtccaaagacagacagacagacagacagacacacacacacacacacacacacacacagagagagagagagagagagagagagagaaaatttacatagtcaaacttgctattgtatatatttccatcacaggagagagtgaaggactagaagctgtaatccaatttgtgtatgacttacttttatatctatactattatacccatactttgccctctcttttagagctaagtctttcaccatggatgtgaaaaataattaatatatcaaaacggattttaatctaatcaaagacaagtaataaaaaaacctgtaaatctaaagttttggggtaaataaaaatgaactctccagttcaaaattacacatatctaaattataaaggatgttaaattctttaatatgaattaatatttctacattttattataaatagatgcttttaatactctaatgacaatatatttgcaataagagtcataaatatcaaattcaatccattttgaaacccagacaagattctaattcatttgtcttactctataaggaaagactttattggaaggagaatgtttttagtaatttttttgtaagatcacatttaatcaaatcattttgatatgcgtatagtaagagtaaatatgatctgtgaaactaacctttattctcttgatgcagtattcatctcagtggtttactgctgaataagttcacctttcctagtattttctgaactctggctggctggttcaatttagctgttctggttcaaactgttcctccccatgctgagtgattcaaactggcttccatcagcttctgactgaattgttctgcttggcctcaaactaactctggcaatttcatttaaatttatcaatcccttttctctaacttcaactgcctctgataacctacactaaactgaatgaactcacaaatgatctcaaccccactgctctgcactcactgcactgtccaactgtctcaaatccctatcattggcaaactgaagagctttcactctccttgcactgctcttaaaatacctttcctcctgagagttgagcatatcctatctctgattcattctgtcgaatcagtctttgatttgtcagtttgtctgcctcttagcttgcttggaattaaaggtgtgtacttatgatttcaaccagaggaattaaatgtgtgtactaagggttatgtctgcattcaaactggatcacaccacctagaaaagatcttggatgtgaacagtgtagtcatatttctggattaaaattccccaactatacctgtttttgttattatctaacacttgtgtttgtaattacctttacaaaccttgaaaaattccttatgaattattattatatgaattatttgttacacatattatgtagttatcatagagtcttattagataacacatccctttgatttctcagctcacaaattggacttcactggaagaggcacaataaccatttaaagtacagaaaaaaataatattgtgaatataattttctcttaaaactcagaatggggaactagcatccaatattcaattttttatggggtcaaggagagctgttctggctgcatagaataacatgaaagcttattcacagtgcattctaggagctaatttatttgtggttgatgttgtgattttaatgatatagacgcttgttccctaaagactgatctgaggccacccatatactaacactctgattcacacaaaaggatgattttcaatcacatcttgtcagacttgtcaaaataaaaccaattttctaggagagaggtgcttgctcattaatagtttcctaaggtcaagatcaagataaattaaaagccatattaaaaattatttgtgtttgcaagcattcatgtgaatgacatttgaggcacaattatgaaaacaaaataaaagtagctaaattagaattcaattagagttttcccagtacttgtcaaataaaaggaataaatttctgtaagaaaatatcaatgaaggaaatgagtcagaacatgcctattactacttgaattctcttctttcttccttgcccatttacctcctctttcctttgcatttaaattttaactgagagcctgcattgcctgctcttccaaagaactcatcaaatatgtccacctaatttctagaatatagcattggattatccatgtttcttcaacatttaccctacactaattcacatcctgtttcctatttcctctatttaagtaatccaaacaatctattgtttcttcatttacctattagttaattctggcatctagatcataatcattatcattttgacatcaattgctcttcaactcaaatttttagttcttattctgtgttaaaataagaaaaatacattagtattcaaaattggtgagtctaggataaaaattcctttgaattaatctgtttcaaattctcagtctgatattcagaatacgtgacacatggttctctgcagatgttttatttgacctcagcattacattactgttcctggaaatatattaaaagttcaagagaatgtcttaaaagccaaaatcagttatgccaaaatgggcatgaaatgaactccatctgcaatcttggtctatagtattacaatctcctataaaaagccttttgcttgcaactattatatagctattgatatgttgtaaaatgcatagtacatacatttaccattcttgctgcttcattttctcattctacagaaatgttatcattgtttgtgcaaactgggacatggaaatatttttgagaatcctcaagtcatgagttgaaatgattactgtttcaatatggtattcctgcactcattaatgctagtctgggtaggtctctagagatctggttaggatgaagagctattctctgggcaatagacttctctccctctcctgtttggaatagatattttctcagctctagtgactcagaaaagtgatcctacctgcttacccttgtcttcaaatttttcatgttttatttagctgatggcacctcattattttagagtgaaaatagaaatctttcttatatgatttctgacatatcactaaaatttttcttgggaataatttaagataaatcagcatctttttaagaataaaatccttattatgggatttattgtgttttaatattcttattcaaaataaattttaacttaaaaacaagttcttgttcaaatgttgtccaaatattaataacttgcatattcctagtgaaacaaattagaatccatactaggccagtctattgaaacagaacaaatagaaaatatgtattataaagaggacttacaagcttgtcttacatcagagagagtaagtagtgttaacagtgacttcctgcttactgctaaggcaggaaattctgtagctgaccagtcaatgaagctgtgtaccccacaaattaaagtccaactttaggagactggaagttcattgggtcattgctgctattgcttctgtgatggaaggtcaaagaaactgtgtttaatatcagtagtattgatagtgcattcattcagaaagaatacacaaaggtaggtaggcagttttctcctcagagctctttataactgaagaatcctttagaaggtgctgtactcttttttttctttttttttccattttttattaggtatttagctcatttacatttccaatgctataccaaaagtcccccatatccacccaccgccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatctgcgtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgaattcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatccttttccaatctgttggtggtctttttgtcttattgacggtgtcttttgccttgcagaaactttggagtttcattaggtcccatttgtcgattctcgatcttacagcacaagccattgttgttctgttcaggaatttttcccctgtgcccatatcttcaaggcttttccccactttctcctctataagtttcagtgtctctggttttatgtgaagatccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtccttctctataccagtaccatgcagtttttatcacaattgctctgtagtaaagcattaggtctggcatggtgattccgccagaagttcttttatccttgagaagactttttgctatcctaggttttttgttattccagacaaatttgcaaattgctccttccaattccttgaagaattgagttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtacgttgtggcttcattttcattaaactctaaaaagtctttaatttctttctttattccttgccttgaccaaggtatcattgagaagagtgttattcagtttccacgtgaaatgttggctttccattatttatgttgttattgaagatcagttcttaggccatggtggtctgataggatacatgggacaatttcaatatttttgtatctattgaggcctgttttgtgaccaattatatggtcaattttggagaaggtcacgtgaggtgctgagaagaaggtatatccttttgttttaggataaaatgttctgtagatatctgtcaggtccatttgtttcataacttcttttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcgtgtaagcagcagaatgttgggtcctgtttgtgtagccagtctgttagtctatgtctttttattggggaattgagtccattgatattaagagatattaaggaaaagtaattgttgcttccttttatttttgttgttagagttggcattctgttcttgtggcttacttctttttggtttgttgaatgattactttcttggttgttctagggcgtgatttccgtccttgtattgcttcttttctgttattatcctttgaagggctggattcgtgaaaagatattgtgtgaatttgtttttgtagtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctaatgctcgcatctatggttccagatctctttcctagggtttctatctccagcgttgcctcgctttgggttttctttattgtgtctacttccccttttagttctagtatggttttgttcatttccatcacctgtttggatgtgttttcctgtttttctttaatgatttctacctgtttggctgtgttttcctgcttttctttaagggcctgtaactctttagcagtgctctcctgtaattctttaagtgacttatgaaagtccttcttgatgtcctctatcatcatcatgagaaatgtttttaaatctgggtctagattttcggttgtgttggggtgcccatgactaggtggggtgggagtgctgcgttctgatgatggtgagtggtcttgatttctgttagtaggattcttatgtttgcctttcgccatctggtaatctctgaagctagctgttttagttgtcactgttaagatcttgttcttcaagtgactctgttagcctctataagcagacctggagggtagcactctccttagtttcagtgggcagagtattctctgcaggcaagctctcttcttgcagggcaggtacccagatatctggtgttcgaaccagactcctggcagaagttgtgttccactcactagaggtcttaggatctcgtgtggaatcctgtgtgggcccttgcgggtgtcaggcgactccgctggcaaggtggcctggggctcgagtggagcggaagggacttgtgccccagatcaggcccgggtagcctgcttccctatgtaccacagtctcaggttccgcgcgattggattggggcaggcgctgtgttccactcaccagaggtcttaggatcccgtggggcgtcctgtgtgggcccttgcgggtgttgggcaagactctgctggcaaggtagcccggggctcgagtcgagcggaagacggtgctgtactcttagaaatcaggttttttccttcaattaattagagtgaaatgccctcataccaggaatatgtttctaaatcccatcaagtggaaaacaccaacctggagggcacctgcttttattaatctatagaatagctatgggttgatgttgtttagtaaatgactgttgtgttgcttgcatttcaaacacttgtttttcacatagtagtaccagtttaggaggtagtggaaccagtatgtggtaagagtaaattggaagaagtataatactttggggtgggtctttgaaggccttgcttttagccttgcttcctgttttcagatctttctgataaacaacttctgtcaccacaccaccgaacaacacacacacttttgatgaacttatctgccttgttttcattgccacattggactgagactatcagaaacaaccaacaaaaaccatccattgtttaagttgtattcattcaggtattttgttctgagtcatagaaaaatacctacaaatataattttcaactactggtatattaatcatgtttacctaatgttttttttacatcctgtttattttatattacaaaaagattttgaaattgaaaatactcattttaacatttttgagtaaaataaaacatacatttctagtatattataattttcaaaaatgtcacaatttcttttacttgtctaatagacacctggatcagaggtgtgccctccatttctggattgtagttcattccagattaaaagtccaaatgaagacaataaccagtttataataacacctaacataatataactatcctttattcaactgcaaacataaaaacaataagcttagctgggagagaccttgccctgagattaccacttccttactctgcttatctccttgaactcagagttcagctccatttcacatcctggttccccttcattacttaaaccaaacattttgtatttttccttcctgaggtccctactcttgatcaaaagcttcaggagagtaaaccagaggacaaagtctgctgggcttttgagagacttcctttgttatgcaattgatttgattcttttcaccttagacagcctcaggcagactcttcagacaggggtcaaaaccagccacattcctcatcaaaataacacaaaacagtttctagaccacaagctatcatttttcaccacctaaacatcttgagccagacccctagagctcaaatctccctcaacatattcctactatgaaggctcaataaaacccaattaaaccttccacagctttccaaatccaaagtaccaaagtctccctttctccaaataaaattatgttcaggcccatgacagcaatatccccatccctggttccaacctctgtcttacttagggtttccattgctgagaagggacaccatggccaagctcttagaatggaaaatatttaattgggggtgtcttataattctgaggttcagtcccttgtcatggcagaaggcatggcaccatccaggtagggcctttacaggaccaagggtctctcctcccattgatgtccaacaaggctatcatctgctacatatgtggctggagccatggtttcctacatgtataatctttggttggtggtttagtccctggcagctctgggggtactgattggttcatattgttgttcttcctatgggttttgaaccccttcggttccttcagttcttgctctaactcctctactggggaacctgtgctcagtccaatggttggctgcaggtatctgcctctatatttgtcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtaaatataattacactaaatatagtgatttatataataagcattcatttgctcaaatttctatgacactatcacttaagctaaactcagctaggtggggttaactgtgctatagatgaaatcatttggcctcattctaatgtataggaactcagctaacatgaattaaatctccttcttttgtaatggttatcctttaagaatctagtccagcttcactctcatgctggcagaaggcttcctagaagcaacaagacaatgacagatacatgatattataaaagtactttttaatctttttctatgtgccatctttgttgatatgccattgacaaaagttccacagacaaaaccagtgaataaagaagataaagaagtacgttttaaaaaatcattttagaagatttaacatttgacatacatttaaagaagaaaaaattcaggacttatttaagatctattagactgatctaagaaattagtatatttgaaaatggaggttagctactttgggcaacaatgtatgtatgcacatatttacctggcaaggattataatgagcagcacccgaatatggccaacatgatgagatgtttaattggctgtaattcatctacatttattcatttcttcttttacttggtaaataaagtgctttcaaggctttcaaaaatagactgaaatataatatatatataaattagtgtaaagtacacatactagtgaaaaagtcacatcaaaattaatggtaattggagatgataccaaaagtatgaatatagactagctttcatgacagtggctttttttgcctggagtttatgcatatacatacacatatacatacacatacatgtacacgtgtacatgtacaggtaaatgtacacatgtacatacatgtgcatgaacatgcacacacacacacacacacacacacagcttttgtttgaaagtttcagagaaaccaatgttgtgcttttgtggtagataaccacaagtgtatttcttcaagtaaacaatgctttactctgtgaaggtagaccatctaaacatagtatgtgattttctattttgtagaatattcatcagatataaatcctagcattggatgcatcatggagacaaagttcactatgaggtcagctggatactatgtgtttttctgggcattcaaacttgaagcactaataatgtttcaaaaactgaaccctccatcttttcctatatttactctcagtgagaaaagggacctcgctagtgagcagaaaatcaattgctgactctctggggagcattaagtttgacttaccagtaaggcatcattatctcctttagaaccctgctggcctacctatnnnnnnnnnnnnnnnnnnnntttcagagttatacattttatacactatgcaaggatgtccttacttttaaaaatagaattgcatatataaatgtgttggcattctgtaaagatcgttagtagcagataaaacttcaaacagcataggcccaaaattgacttttacctgacccgttatatggctgtgaatggtaaaagcatttgggatgggggaagtattctgagagagggattactgggagagaacactaagcaggatgtaaagtaaataaaaaaataaaataaaatttaaaactaactctgtaacttcatttaagtgaaatgatttactttcttttcctgattaagttgcatgaaaaatgtgtgactcaatcattttgaattcttattaacaatggatggtagagagatggctcagcagttaagagcactgactgctcttcagggggtcctgagttcaaatcccagcaaccacatggtggctcgtaaccaaccatctgtaacaagacctgattccctcttctggtgtctgaagagagctacagtgtacttacatagaataaataaaataaatcttaaaaaaaatgatggtaatattcttttgacttaaggacagtatagtttatattgttcagggagtttcttaaataccaataaccaatatttcaaagggagatttcctggcaacagtgtttttttaatatttatcgtggcttttgaaaacatcctttgttatatttatgtttcctttctccctttccctgtgcactccccttactctccatcccagttaaaatcaaatccaaattttcaacttttttccttctctgaaccttctcttctatcatctgtggtcccttactgccttccgggtttctgaagttacttcaagatatatattcacatctaaaagattcaaatgtatgatccacatgtgtttatggttgaaaaaattatagatcatggagaacctactactgtcatttttctttcatcagtttaatttttaactatattttaaatatttatcctcctactcacaggtaagtgtagctctcatccccagtgaaactaactttattttacaatagaaaggagcttctgcagagatcaataattagtcaaaatgcatagactaagcagctctaagctgtaatttacatctaaaatgcaacatcaacatgtaagacttacggaacaaaatgaaagaaggggacgaaagattataagaacctgacgacttgaacacatgctactagatactgtcttcttcagttgacagggttgctacatccatgaaatctcaacaataagtttcttaaacaggatctgcataatgacaacattggttaacatgacagtatggaaagtaaatttttcagaagtccccactcttcagtgatgagcaactataggcaatcaagggattttcaaaggaagactgggttttcacgagatataagccccctctagaaatacaatcccaagttgtcagctctgaacataaatacataaaagcaacactatttgggatgctttagctacagttttactgctgtgaacagacgccatgaccaaggcaactcttttttttcttcatttcttttttttaattaagtatttatttcatttgcatatccaatgctatcccaaaagtcacccacacgctctcccaaccactccccaaccatcccacacccacttcttggccctggcagtcccctgtactgaagcatataaagtttgcaagatcaatgggcctctcttcccaatgatggccgaactaggccatcttctgatatacatgcagctagagaaatgagctccggggtgggggtggggggatactggttagttcataatgttgttccacctatagggttgcagttccctttagctccttgggtactttctctagctcctccattgggggccctgtgatccatccaatagctgactgtgagcatccacttctgtgtttgctaggccccggcatagtctcacaagagacagctatatctgggtcctttcagcaaaatcttgctagtgtatgcaatggtgtcagcgtttggaagctgattatgggatggatccctgcatatggcagtttctagatggttcatcctttcgtctcagctccaatctttgtctctgtaattccttccatgagtgttctgttcccaattctaagaaggggcaaagtgcccacactttggtcttcgttcttctagagtttcatgtgttttacaagttgtatcttatatcttgggtattctaagtttctgggctaatatccacttatcagtgagtacatattgtgtgagttcttttgtgatggggttaaatcactcaggatgatgccctccaggtccatccattagcctaggaatttcataaattcattctttttaatacatgagtagtactccattgtgtaaatgtaccacattttctgtacccattcctctgttgaggggcatctgggttctttccagcttctggctattataaataaggctgctatgaacatagtggagcatgtgtccttcttaccagttggggcatcttctggataaatgcccaggagaggtattgctggatccttcggtagtactatgtccaattttctgaggaaccgccagactgatttccagagtggttgtacaagcctgcaatcccaccaacaatggaggagtgttcctctttctccacatccttgcaagcatctgctgtcacctgaatttttgaattttttggccattctgactgatgtgaggtggaatctcagggttgttttgatttgcatttccctgatgattaaggatgttgaacatttttttcaggtgcttctcagccattcaatattcctcaggtgagaattcttggtttagctctgagcctcattttttagtggggtatttgattttctggagtctaccttcttgagttctttatatatattggatattagtcccctatctgatttagaatagataaagatcctttcccaatctgttgagggcctttttgtcttattgagggtgtcttttgccttgcagaagctttgcaattttatgaggacgcatttgtcgcttctcgatcttacaagccattgctgttctattcaggaattttccccctgtacccatatcttcaaggcttttccttagtttctcctctataagtttctgtgtctctggttttatgtggagttccttaatccacttagatttgaccttagtacaagaagataggaatggatcaatttgcattcttctacatgatagctgccagttgtgctagcaccatttgttgaaaatgctgtcttttttccactggatggtttttgctcccttgtcaaagatcaagtgaccataggtgtgtgggttcatttctgggtcttcaattctattccattggtctatttgtctgttgctgtaccagtaccatgcatttttttttttatcacaattgctctgtagtacagctttaggtcaggcatggtgattccaccggaggtttttttatccttgagcagagtttttgctatactaggttttttgttactccagatgaatttgcagattgccctttctaattcattgaaggaaactcttataaaggacattcaactggggctggcttatagcttcagaggttcagtctactgtcatcaaaatgggagcatggcagcattcatgcagtaatggggctggaggagctgagagttgtacctctctttctgaagtccgttagaagaagtctgacttccatgcagctaggaggagggtattaaagcccatgtctacagcaacacacctattccaacaaggccacacccacttcaatatggccatacctcctaatagtgccactcctggactcaaaatatacaaactatcagagagcttagtaagttttnnnnnnnnnnnnnnnnnnnnnnnnnnnnnnnnnnnnnnnnnnnnnnnnnnnnnnnnncttaactgggagtgaaggggacatgcgagaagatgggggaggagactttaaataacataaatagtataaccatatattttaagataaaatctaaaatagcatagtatgtgttcctttatcatgataaaaatatcatatgaatttttgtttttcaggtatcatttaatacattcaaaatcattttgaaaaacatttgagttctttttaataataatagtaaactaaaaaacaattcagttgaaagacaaaatgaattttaagtaacttccagtttaatgagtatatttatagattgagatagtagttaaaagaataaaattgtctaaagtgtgtaatataataccaactagtttttaatactttttcttaaatattaaattgcaaaagaatgtcatgttaaatataactaaatgatgaattatttaattgtgggtgagtataacttcattaaatctttaataaatattttgatggaaattgtttatactttattgttgataagtatattttggcatttaatttagagtgtagaaatctgtcccttaggccagtggttctcaaaacttcctgatgccttgatgctttaatgtagttcctcatgttctagtgacccccaaccataaaatcatttcattgctatttcaaaagtatattttgttacttttatgaattgtgaagttaatgtaggttgttttaattaattgtctaaaaataagatgtagtttcagttctgatatttttttttgtttttatgagacagggtttctctgtgtagctatggatgtcctagaacttactctgtagcctaggctggcctagagaattgcttaagttctccttgcctctgcatgcctagtgctgggattaaatgtgtataccactaacacctggctcagttctgccattttgaataattgattaaagtttatatatccagtctcatctgcttcctatgagcccacacatatccttattttaggtatcagttttcttctggtgagatgacacacacaaacacacacaacttccttaaggataatgaggaacccaacagtccattacagtgcatatattaatcatcatttagcaagaaacaaagaatttggaaacacagttgcctccaagaaacccagttatacttttatgccatttggaatagtctcacaataaataaaacagttttgtgttaaagctgatggatagtaaatagttcaaattacactctgaccagagaaatattaagaatcatgcagcatgtggctgatatttaatctaaatatagattcaaaattgttagattccacaggatccttattttgaataactattttttacttctctttttttcctgtgtcaatgacaaaattgaattaagtattaaaactactatgtttataatatgatccatcttcactcattttctcttctcctgtgtaagtgtgtagctactagagttcttaccaatgtgtgttttcatcatataatgtacatttgtgtatgaatatattataattgcactcaaatgtttttcacaataagatagcataattatctaccttgaattggtatgtggaatactgatgttatccagtgatcaatggctgtcaatcacagactgttgctttagacttgtttttctacatgattcaaacaaagaaacatgtctgtattatgaagtcctacatagaaattatttgctcatataacttaatcttacttaaaatgcacaaacctagaatagcttcatttaagggaactccttcttcaagctgctttctggacatcgtgggttgaacaagtttattttaccacctgttcctgttatgaaataccattttcccacaaattcaaagcaccatggacaggccaccatgaactaaaatcactaacataaggagtacaaagaaacctttcttcatctttaaaaattacctcggctattttgccatagtaatagaaagctatgagtctcctcttacaattctaaaattaattctaagcaaaaatttttgcacatactcaattattttatataatttttctaagaaaataccccctaaattttgtgtacttaatatataacttgtaaaactaacgtttattctctttatgtaattgtcatctcagtggcttactgctgattaagctcaccctttctagttctttctgaactctgactgggtcagctcagctgttgtggctcaaactcttctccaagttgactgactgaatctggcttctttcagtttctcactaaattgttctgctttgcctcaaactaactctggcaacttgttctgatcctctggcttctcagattccaactgtctcatcaggaactaactcaactccactgcaacacactcactgcactgacttccaactgagtgaccaaagctactgctgtgctataaatagctgttttgtgagagttatggatagggtgtatcctatctctgacccatactgtctaatctttctctgatccatcctattgtctgctcctcaattagatatctctttcaaatacggatgcttccttctagaaactgactgtaatgttagggattaaagctgtatactgagggtatgtctgatttccaaccagagatattaaaggtatgtggtgttgtgtctacattctagctggatcatagagaccttagaaggtctttggatatgattagagcagacatgttgctggactggagttcctctaaaaaattgaaaagagttgaatatagtgagcattctaaattatatcactaattagaaaggtaaacattataaagagatagatttagtatatgaatataatgaataactatggaacataagcattttccatagtaaaagacatcattaaacacaaacattccattgctaacacttcaattgcagttaatatccttcccattttcctaataaggaaataaagattgagatgaataaacaatatatttccaatctattactataaaaggaaatatagtcttgacttcagattcctaggaaggttgctcgtagaccaggctatgaatagaagtagagtttgaaaataaaattataataggaggcacaaatgaataagggtgacagtgtggatatatttatctgtccttctgagaaatgagaatagaaacagagacagagaaccttgaaataaaaatgttttgtggtaatttcccattattgctgtgaggtgtgagtgtggtgtactaagaggtataaataaaaggattgattttagtctgattctttaaatttacccactaggtgaccactttgtaaattcccagagctcctgtaatatttctggtcagtgaaaaaattcttgctaaatctaaattgagtttcataagtgaagtgcatccctttctttctaagaaactctaacagcaagaaaaatatctgttcatgatattggtcaataaagaagacttgacttatcttaaatgaaagtaaattaagcaaagacacacacactgagagataatgtaaagaggaataatttcagtttctaaaactatttttactgtgttctaatgttagagatattgaaaatgaaattgaaattgaaattgaaatacatttgtatttctggtacagtttaaaagagaagaaaaacaggaatggataacaatagaaattaggcaagggaagggcagttatattatagtaacttgtgtaagagcagacatgctttttttcactgttctgattctacttcctcaatagtaccaatcgttttattctagtaggtatattgacttagaaaaggcaaactgaacaaaaatgttgaagtagaaagggtatttttcaaatttttaactttgtaatgagagattaggttgacaaatctaagtccattttactaaatgaaaagatatatcaattttaatcatttaattaatatttgaataaaaatggtcattcacaatataactgagaaatggctatgaggtggtgacagatttgtaaaaatgtgataagactttgacagcttcaaggacagagttacacatagatctatatactcttaaaaattctatttatctacaaagatgcaaagttagcatcttaaggtttgtatgggcaacatgatcttattataacatctcacctctacttttattgcatggaaatagttatgtatcatcaaatgaacattattgagttcaagctatcacctacaaatacaaatgagcactattgagtccaagctatcatctacaaacacaaattaggatgagctagatgttatccattgtctaaagtttgctgacctctaaactaatacatattcatatattatatatgctctatattgataatatataatattatatacaggaacattttagtagcaagaagtaacaatacacatacatatgatttttttgtactcatatagttgaacatatgtcaaaacattcagttttttaaattcaacatttatttatattatagttaatctggtaaaacagcttcattgatattcaattcaagcaagtcatttaaataaggtgacaacttcatattacaaactgctttaaacaaattggttagattccagaaatcacctcataaaccacacaaactcaaacctcagttagacagggatggtttattaaacatataccatccaccccaggactgatcaatcagggtcacagtacagatccaggaactgaacagtgaccctgaattaagattctacaggtttcttaaagcctaaaatctacaaacatttaagtcaagttatttcactaatcaagatttaggagtaggggatttccttagaaacatgtctttgttgtacatttcttctgttccctttggttgggatattcaactctagcatgaggctggcctcatctaatgccctaacttgttatgaagatggaacttgtctaacattcatgtcctaccttgctaaccaggatgtcagttacccacatacatgcctcttactgccaagtatgatgccagtttccagggaagtcttgggaactgaaactttactcgaccccttactcaaaatggaagtctttcttattttagatatttccttatatatcttatgttgggatctatcccagggatagcttataaaagcaaatactatataagcttatacataggtcagggagtgttgctgagtagttgattcagatcaaagcttattacaagtaactatataaagcagttctgctgacttttaccatgattagttaccaagggcacagaacagaatatttaatcaacttggcattagaacgtttcctagtaacagcagaaacatatgacaaaggttcttataatggcaggatggccaggtaactgttacctaggccttaacattttactgtggccttaacattctccaattttgagttgtttctgaaagtcgaatctttgactctaaagtttctgaaaccaaggagtcatattaggtacaaagaatcataagctggagagtgaaaatgtgctttttaacaaaacaaactgtagcgttaattatgcaaggtccacagatgagagccaaaaggaggcatagaggatccatcagggctattctcaatggcattgtttgtctttacctaaggttatctctaaagactttagaaccattagtatagaaacagcattgtttatctagccttctatctccttacaagagcaactcctatgcaatagtttatcccaacatagacatgttgaacggtctttacccaaaactttttcttttcttagatatcattggctttgtatttggtagcttgattatctggatggatagtttgtgtctactcatgtgatgacagaaggactatgctggcactataggtagctattccttatgccagatggtttccttttaacttagcattgcagcctgttacatggacaatagacattgtattctcatctgtaactacttccttccgatattaggacattgacatcaaggcacagtaaagcggaaagtttaatcaaagttttggaaatggggcatttttcagaagcatatgattagctgatgtagctgaaaggcagagagcaatcacatcagcaagaccagttcacatatatcagctttcagcaagtcagagctcagcagcttgcaatccatagatgatctctgaatggagtgtttcagccaggtgaaaatctactgagacaaatgtaaagtaggaaccaaacttaaaattgtgtaataatggggtaagggaggaaatctcaagcccaaggggaaatcccattctcaaggaaaggccgcagacatatttggagccctttgatctgtagcaagtggatttaagtcttatgacactggactccctgaaaattatgtgaattttggaaaaagcagttaataggtgtctgtaagacagcaggaatagacatttgcagttgagaccttgtaaaagctataagcttgggttaaaagacatgaaacatgtagtgcagagggctaggtgtacagattgaacagagatgtttttaagtctaaaatcagaatacaaccaaagggaatttaaattcttgagcttgtaattgaattgtaagcatccagtgtgttccatcaacttatcagaactccattgatcaatgttaaataacaatagcatgtggggagaaatatgaaacattttttcctcattcatatactttatttttatattgcaataacttatatttatatatttcaaaacatcatttcaaaccctctaatgtttataaaacatctttttagacatttaaacaatttctaaacccttgaacatattttagaagtttttacatccttagactttatataaacattattatatgttcagttcccaaatcttggatattggtctgatcaattactcctggggcatatgctctataaattatcactgtctgactgagataagtattcatgaggtttgtgaggcaactcctggaccccaacaatatgcatatttatcagtgcctttaaagaacctgggacctagccttatgaaaaatattctgaaatgtgctaaataaacttaaagaacaaatgtagaatatgcatgtatcacttattgtacatagttttacagatagcagtgcataacaggaaataaggttgtgaaggtttgatgctatgtatataatcccatcatcattcatcaattacttaaggtcaaagaatatgagagtatgaagataagcagcatatatagagatacataagataaaatggtggagttggcatatgcctaatagaaaaatcctagcaaatgtttcaaaagcattttaatcagtaaccttacagagatgtagataatataattaaagcattttatgaactttttctacacaattcattttttcttttattaaataggaactagaattggttccctctccatctacattctactttcctctctcccttttccatttgtcctttcccctttttctctacatggcttattcttttatatgcattgcattaatcagcattttaagagtgtttaatggtgactcatatgaaaaaaaaagttctgattttgttgattacccaaaataaataagacttacagaaaataattataatgaatactaaattatactgaatagaataattatagtgagtagaaaaataacactataatttttcattcaagatcaacaatttattgttttttacaggaaattgttaccgatttcaatgcaacaattgttttagggcattttgggaaaaacaagaagaatatctgtttgcatcgacaatgatgcttataattcagttacaagctgtcagggtaaagattatttagctagtctgagtagagttatcaaaataaaaaaagtcaaggaagtaacaataatcggaaagtactacaatgaagataacaaattaagcgtattaaatatctaaagcccatcatttcaaacagtgcagaactattattttgcataagagagcattatgttttgttcttccaaatgttaactttctttaaaaaatacattaagtatgcctaggttactcaattatttctttgtgtctgttttcttcttttaataggatgctcattcagatttaatagaaaatgattgctcaagaaaaaataatatacccatttcagtgaggttacccatggcattagttaacaccatatacatccagtaattgtgcaaatatatttttagaaaagttcctttgagccttgtttttatttggggtattttattatttaactgtttatactataattaatagcgatttgtgatataacaaattcaaattctttccctagcatatctttccattgtaggtctacagttattaacattgtattttcagatgctttctaacaggggacactctctcactttttgatctcaatgaaaatatggcttttcttagttttattcttcctatatcaaaaatacctagaacagtgctagatgacatgaggacaggtgatgagtaagtctatgtgaataaaagacttatgcttcacaatgccagaaaacaagataaaaacagtttgtctatataaaataattggtaagagcaatgttaagtatgcagccattatgccatgtctaaagtggtatataatctgcctcgtaaattttgagaaaagactctgagttatagatctcatttctttcccacatgaggaaaagtagaatataatgcaaatcctggcagaatcatctatctttacacagtacttttaatataggtctaattaataatagaaattaaagatatccttacatcacatgtttatctgtgaagtaagtgcaattttggttaacatgtgtgtatgactctacatgactgctggaagagggaannnnnnnnnnnnnnnnnnnnccccccaatcccctacccacccactccccctttttggccctggccccgccacacacccccgaccccgaaagatgggcacccgcggccgctcccgtcccgttccgactgaggcaccattgcatccacatccttgccagcatatactgtcacctgagtttttgattttagctattttgacagatgtgaagtgtagtctcagagttgttttgatttgcatttccttgatgactaaagatgttgaacatttctttaggtgcttttcagccattaggtattcctcagttaggaattccaatttttttttttttttttttttttttttttttttttttttttttagctctgtattccattttggtcctcttgagtccaacttcttgttttctttgtatatattggatattagccctctatcagatgtagggttggtaaaaaaaatcttttcccaaactgttggttgcctttttgtcctattgacagtgtcctttgccttacagaagctgtgtaatttcatgaggtcccatttgtcgatccttgatcttataataataatgttcagtaaaatttctctcctgtgcccatgtattagaggctcttaaccattttctcttaaccattggttagtttcagtgtatcaaattttatgtggaggtctttgatccacttggacttgagctttgtacaaggagataaaaatggatcgatttgcattcctctacatgctgacctccggtagaaccagcaccatttgttgaaaatgctgtgttttttttttccactgaatggttttagctcctttgtcaaagatcaagtgatcataggtgtgtaggctcatttctgggtcttcaattgtgctcctttgatctgcctgtttctatatattttcaaacaccttttgcaaatctataatagatttttatatgtgtgataatctcttcaaaagagggtccaattttattctttttaagttaatgttttattttattgttcatatttttgtatcacatttgagaatatttgactcatttcatgatcagaataagacttttgttttcttgtagtctataagtttagctcttatttctagtggttggtcaacatttatgaagcaaaagttatgattgataactgtttatgaaatatattagatgagtatatataaacaaatttaaataaaatttctccttgcatatagtacacttgagagaaaatccttcccctgatattagtatatctagaaatgagactatttcaagtatctgttattagtttccagatttataacaaatattggtagagcaaggagaacatttgtctattgccagtttgaatgaaaattttatagcaactttggaaatcaatatgccagtttttcagaaattttggaattgttcaacttcaaggtctagctatacaattcctgggaatatacccaatggatgacccattatgccccaaggacacttgctcaaccatgttcatagcagcttcattcataataaccagaaactggaaataacatagactatgtacatttaaacaacagagtgttactcagctgtttaaaaaaaattatcatgaaaatggcagacaaatggatggaattagagagaaaaaaattctgagtgaggtaacccagacccagaaagacaaatatggtatgtattcacttataagtgcatattagtttttaagtaaatgataataaagctacaattcacagacccagtgaggctaagtaatgacaatggcaggctctaggagagactcatggatgtcctggaaatagagaactagaaaaaatttcatgggtggactagggatggatagggagagaaaaagaaatgatcaggttagaggggatggagggagtaagagagtactgggaaagacaactgaaagtagggtgtttgtgggatgatgtgaagtctagtgcatttgaagctccctggactctacaagggtgacccgagcaaagtaatggggtatatggaacctgagacagctatcttcagtgaccaggcaaaacagccagtgaaggggatgtgatggcaactcacccacaaaaccctcaacctacaggacatcctgtctttaagatgtgttggggtggcacagaaatcgtgggaagggcaagccaatgactgatccaaagccaatgattgatccaaaattaaaaccacatcatgagagggagcccatttgatactgccctgaagatcgtgaaccagaggctggagagcccagacccttaggataaaaccaaacacaactggtaaaaatagatcaataagatgattcctaatgatattctgatatactcataaggtgcagcctagcatatttctcaacagagaggcttcatccagtaacttattcagatgcagaggctcacagttaaacattaggtgaagctcggggaatcccatggataaaagtgaagaaagattgtaggagccaagaggggtagaaacaccaggagaacatgatttacagaatcaactaaaaagcagggcttatagctaaccagaaagactaaaacaagaatcaaggacctatgtggttctgacgtaggtcctcagcagatatattatggttgtgtagcccagtgttcctgaggaactactaatagtggcagtagggccctgtttctgattccatttcctgttttggggacattctcctactactaggttgcctcatccagccttgatatgagagtttgtgcctactattattgtaacttgtgaagtatttgtttaatattcctggaatgcctgctgttttcccgaaaggaaacagaggaggactggatctacgggagagggcaggtgaggaaaagggggactgggaggaagggagtgaagggaaactatggttgggctgtaatatatgagagaagaataaattttaaaaaataaccctgaagttcacaaaactggaaaacttaaaataaatggagaggggggtagggaggaggagggaggagggagggagggagggaggaagggannnnnnnnnnnnnnnnnnnnaatataatagtagtcagggaaaaattattccagtgatacatcctgaccatatgataagccaatgcaatagtatccagtaaacattactatatgcaaagacatttgaggcaaaattcaagatggatgagactccaaattgatatttttacatcactgttagggaagctaactcttctacttaaaatctatggaggcaaacatatggcagtaggatctgaaatattgtattccaggaatgtaggactgaacttcgagtttctaagaaatgacttagtaaaaagagaagtatcacagaaattcagtattttactgaacatgtttctagattcaggtgttacagtaacctttattcacctgatgtaagtgttatctcagaggcttactgcctcaggctgctaaccttggcctagccctggaaaccttgtatggggacaatctaatctagtcctagagtactttcagattcttagacttactgctgaataaggtcaccctttctagctctttctgagctctggcaggctgttcaactcagctgttgtgactcaaaacttcaccaagctaactgattcaatctggcttctctgtctctcctgaattgctcttcttgacctcaaactaactctagcaattcctctaatagtctggctccttgttgttctctgactcattctgtcttcacctgtgtctagtttgttttctctctgcaactgtttctctataaactgctcaataaaactgcctccttcttccattttttctctctgtactgctttcctaaatagcttccctttcctctctcttctcatgagaggtcttaatgtcctgttttgtcaaatcttcctctgattcatcaatttgtcactcaattagacatcactttcaaacatggctacttccttctacaaactaactttaccctaatcgttggagattaaaggtgtatactaaggctctattccagccaaagggattaaatgtatatgctaaagttctgagtcacaccacagtgagaacagttttttttcttcagtaaataacannnnnnnnnnnnnnnnnnnngtaaataacacaatattggggtttacagtgtgatcaaatattgtacaacaaataggaatttgtcaggctcagtcaaagggattggtatatatgactggccatggatttttgaagagttactaaagatgtatttgttaatcatggaaacattaaagaaaggcagatgacatatgatatcttatatgtgtgcaatttaaaacagaaaagcagaaaatatgatggtggtagccagggattgacagcaggagatagagagatattagtcaaatgatacaaaatttcacttagtgtcgaatacatctcagagatcacatggtggtatttgatagcaatgtattacatattgaaaattatgaagcacagatttgatatggtttaactataaaaatgacaagcatgttaatatatatgacacgtaactacctttaaacactgggtaatacatgttcatctcaaaacagactgtctacagaaattataaaaattctctcaatttaaaaattagaaatcattacaatagaaaaatagtgtctgatttccaattcttcttgtcacactaacttaaggtcttcactatctcctttccagactacacagatactctttttttgtcctttttttattattagatatttatttcatttacatttccaatgttatcccaaaagtccccccaccctctcccccacccacccactcccacttcttggccctggtgttctgaggcatataaagtttgtacgaccaatggtcctctctttccactgatggccaactaggccatcttctgatacatatgcagctagagacacaagctccggggggcaatgattagctcatattgttgttccacctgtaggtttgtagacccctttagctccttgggtaatttctctagctcctccattaggggccctgtgatccatccaatagctgactgtgagcatccacttctgttaggccccggcatagtctcataagagacagctatatctgggtctgatttgttcccttattcgctgctctcatgcctctactttgttccactccttgaataacaattttagaatgaaattgctctgattactctttaatattaactatttagtggtttaattgcttatcagattaggtgcaaatttctcatcctggcactgcaaactcaaaaaaaaaaaaaatagtacacttacactcttatctgtagttctatacagaaccagtatgtgtgctataataaaattattttgtttttaacaattttcttcataaacaatgtccagtgttctcctaaaatctatttcaatatctcagaataccaaaatctatccagtctttaagaatgttacctcttaaatgaattttttttcatttatccactttgacattggatcattttcttgctttttcattgttaacatttgtttctatttatattaaattattttatttatttatattccaaatgttgcctccattcccagtaccccgtctctccacgttctttagctcctacctactcccttttgtttctgagaagttgccccccgaccattccctggggcatcaagtttctttaggattagttgtatcttctcccactgaggttagacaaagctggccaagttgtagtggcacatgctggtaggatatgctgaaggaggcagaaacaggagagtcataagttcaaggacagcctgatccatatctttctcttaaaactttgcttagttgacaaactagggtccactaaccaaatcgaccatatcatgttttatgagggtgccaccatgcttattcatttactacctgtagctcctttcatgctatgatggcataattgtgcatgcagtcatccattggtgtctgcagcatgttagttctggtacttttgtggataatgaatctatgaattctcatgtgccatactcacatatgctctctgatactgtaagtgataaaaataatttacatagattttaatacacagttttatatacttacttaaattatttattttactttttgcagattgaaataaattatatcacttactcctttcttatgctccacccaaaacatcctatatactcttcctttctttctttctttcaatttcatactttttattaattattgttatattatatataacatatatatacatatatgtgttgattatttatttatttgtttgtttatttatttatttatatattcctaaactcctaaatacactatgctcagtctctacattgttactagaaccagggttgttatgtgatccaaacaccatttgaacattatgtctatataacttgataacactactccctttatccatgttcttataacaatttggcagtgatccatagtctaattattgaaatgttaataagattactgcaattaaatattcatagtataggaatgaaatttttagaagaaagaaaagtaaaatttaacataaattgcataataaaaatttcattttcattgagttctttggactctataattagtcataacagttccaatgcaattttattactgtagaatattttatcatatgcaaataatgataaaatatgaatggaaacattcttctatactattttgtaaataaaagtgcatcattaaaatgtcatttaaaagagtatggcattaaaacttttgagacattggtatttctataaatataaaaactttccaacagactaagaacataacatttttctcattgcatactctgtatctaccataaattacaaaagttaatatatgttcaataacccccattttaaataaatgttcaatttttcttttttttttaacttgtgactggcaagttcttgttggaacattttgatgtaaactgctttcttttcaatgtaagccacattttaaaccatatccaatgacaagacacctggttatatcaatgttacttttataatagtcatatttgcagcaacccaatttccctgaacctctacctcgaaaactcccatgaattctaatggtttgaattcaagttctatttacttattctgttttttttatgctgatagttcccaaaggaaagatattgtatcccttcagaaatataaaacaaaacacatcaataaaaatcaatttggaagatgagacaaaatgatctaaccaatgggttttataaataattttctcttattttccatggatatgggcaatggattgtaagaaatttgttgtctaattttaaataacattttatcaaacttaaagatgtgctttgtgttgttttctattacttttctcagagtagataaatctgttttgtacaaggtaccactgtctttacagagtataaaacaatttcagttgatgtctcttctccaattttgaaaaggctcattattatccagtgagtggtatcagtggtttgtatgagagagaacttcattagtgatttggataattaggggaggaggactgatgactcaggattttctttaacttttccccctttcataattttcacatttttaattaaattaaaaggagaaatgaaattacttttaaataggaaattaaatgaaaaaccccaaggcaatgcaagagaaatgtggtttttcttaattaaaaagacaaatgcggtgcaatataaaaatccaagagcctcatatgtgaatgcacattaggtatttgtggtagcacactggaaaagaacttaattaaattaatattttgttttttttttcactaagcttcattcatattttcttgacaggtgccattcatatcattttcttaatatcacaggactttttctctcatttattctaaggctaaaggattgtaaggtagatgttcaattgcctcaatactttcacatgattaacaagtaacacacgattttgtttccctacaaaacagtcattgaagtgtgtattataatatcatggagttggaaaaaaatcacctaaaattttgagggacacttatagccaaagagatgtattcagtcattcaaaagacaactgttttaactctgggataaaatgaggagtatgaaaatgtatcaaagagtctttcaaaagtttctgtttttaaatactttaaagaaaaatgcctataaaagatttcattagccatgatatttgtaacaaataaaatctattactctattctatacatcttgtcttcataatatcagtaattttttcatgaaaaattatgcttcaggtgtcagaatttacccccgtttacaattccatacacatatgcttcaaaaggtagagttatcatattactgatttttgcctgcagatagcttttatacatgaataattgttcctaccacaaaagtcaaaatacttagtgttttaatatacacatagtttaagcatgtcttccatcttctctaatcccttctgtaacctcaaaatcactagtctcccaattttatttttattaactcacatcatctatctatggataactgtgcatttcatgggtcatctgctggagaatgagcaacatcttagagaccacatcatccatcccataatcagcttccaaacgctgacagcattgcatacactagcaagattttgctgaaaggacccagatatagctgtctcttgtgagactatgccggggcctagcaaacacagaagtggatgctcacagtcagctattggatggatcacacggcccccaatggaggagctagagaaagtacccaaggagctaaagggatctgcaaccctataggtggaacaacattatgaactaaccagtacccctgagctcttgactttagctgcatatgtatcaaaagatggcctagttggccatcactgcaaagagaggcccattggacttgcaaactttatatgccccagtacagggaaacaccagggccaaaaagtgggagtgggtgggtaggggagtggggggggtgtattggggactttttggatagcattggaaatgtaaatgaagaaaatacctaataaaaaatttaaaaaaaaaagaaatttcattcttatggcctcattatttaatcttcattacctctgtaaagtttcccatgtcggcattaagtcacaccgttaggggtaggccttccacatatggatctgatgaaccacagctcctgtgctgttggaaagcaagccagaatagctacccnnnnnnnnnnnnnnnnnnnnacctaataaaaaatttaaaaaaaaaagaaatttcattctttgtaagctaataataaaattttaattggtatatgtttccatttgaattacaattcaaagactgatccttaactgtctgttccaagtattcaagagtctttttttacagtgaaaatattatcagttatttatatgaaattcaaatttaccaatggagcatacatttcttttctcttttgaactacacaaatataactgtgtgccactattagtgatatgataaccatgactcagacctacaggcatatatagaaaagctttcatttgaaaatccaggataagaaaccaattgttttatctgaagaaataatcaaataggcttttttgttttaaaaattatttaaaatacacattttagagttaattatattattttctgtgtatgagtgctttgcttgtatgtattaaatgcaccacatgtgtttccagtgtctgtgaaggctatctgatttcattcaacctcctggatgttgagttataaatggttgtcaaacactatgtgtgtgctgagaatcagtcccaggttttctgcaagaacaacatgtgctcctaactgctgagccatctctctagctcgtaaatattttgacaatttcttatcgtcatattcatctagcttactgccttctcttgttccctttctcatatctgttgctcccccttcttctcatctagagctacaaatggaaacatttctgaaagcagcaatatccaggatctattccaaaacaattaattttgaatttctctaactggaatcaattcactggcattttagaaactccagagatgactctaataaggcaattcagtttcaaaactaatgaacagagaacaaatttagcaatggttcttaattatgactgataccaaaataatctaggatatataaaaataccaacagtcaattagtattcaagattgttaaattgtatattcatgcctttcaccatatttaaaatttgatccagaatttctaatctttctcaagaaaatctttaaaagaactaagaaaggcttatatcaaagaacaaaataacaagttaatttataaaaataaataaatcagataacatactgatttatttgtagcataaaaatattggcctgccatggtagagtggtagtagttgtcatcagttgtgtgctcactggcaagcctatcaaacttaagtgaatgcatccaagcctgtgcttacacagatgactgtggttaaatcaaagatcaataggccacaaaacaaaatgaaaaagcctaaatggggaaaagtgatttctaggaaggagggggatggctggtatgggataagagtaatttgaggcatttcatatatgcatgaaaaatataataaaataattaattaaaaatatatgtgctgggctagtatctaggcaacaatatgttgtccatgattgagtgcttaggctagtactttcatgtgtagcgttaagacaaagggaacatttcataaggtgggggtagatagaaagatggtaagagtcaggaacttttctttgggattatgtctccaagaggtgtcaaaaaccacactcataagctatcaccatcatgattactgaaactgagctgaacaaaagtcaatatcaacaatcatgccaaagtataaaaaagaaattccatgaagcatcaattttacacaaagtactacaagtaactaagaaatgcagaaaggggagaaataatctccagagaagagcacacgaactggttgttcagtgccaagttcagtcctgacatcatagcaaaaataatgtcattacactgatcaggttatgctcaggaatatgtgtatatagacacatatacgtataaaagcaataaatacaaaagatagcacaaattggaaagagagcaaaacaggatatatgagagggttaggagggaggaaaggaaagagagaaattatgtaattctattataatttcaaagaaaaagaaaaatattatatcacatttcaaaggggttttatcaaaatattagatgaacatttcatactttaaaataaatctgtcatgcaattatcatagacactacaaaagtcatttggatatcactcattattttgttaatgtacatatttgcataaaacagatactatttctttaatattactcatgtaactatcaacctgtcataaaatacaacataaaataaatgttaattatttgaatttctttaaactaattttaaacatagcctaagatgtcactactaatgtacaaatcttacaaaattttactaaatgagtaaatgtttaaatgttactagtagcatttagtaaagtacagtgatgttaatctgaaccacagcatcactcagacccccaaagatagaacctatcaatcaaggtataggtcaccttcccttccctaatgttcttccatttggctttaaagcttaatctgtgaattcacttggggtcattccatcctgatggaattggaccctttcatgctggattaaatgctctttacttctacagaaaatgtggtacatttacacaatggagtactactcagctattaaaagaatgaatttatgaaattcctaggcaaatggttggaagtgtagggcatcatcctgagtgaggtaacacattcacaaaggaactcacacaatatgtactcactgataagtggatattagcccagaaacttaggatacacaagatataagatacaatttgcaaaacacatgaaactcaagaagaacaaagaccaaagtgtggacactttgccccttcttagaaatggaaacaaaacacccatggaaggagttatagagacaaaatttggagctgtgacgaaaggatggaccatcaagtgattgccatatctggggatccatcccataaacagcttccaaacgctgacagcattgcatacactagcaagattttgctgaaaggacccagatatagctgtctcttgtgagactatgccggagcctagcaaacaaagaagtggatgctcacagtcagctattagatggatcacaaggcccccgatggaggagctagagaaattacccaaggagctaaagggaactgcaatcctataggtggaacaacaatatgaactaaccagtaccccggagctcttgactctagctgtatatgtatcaaaagatggcctaatcggccatcactgcaaagagaggcccattggacacgaaaactttatatgccccagtacaagggaacccaagggccaaaaacggggagtgggtgggtaggagattgggggagtgggcatgggggacttttgggatagcattgaaaatgtaaacgaggaaaatacctaataaaaaataaattaaaaataaaaagaataccttcttagaccaaaagatgacttttatttcatgcctatcaccaacagtggcttcagatgccaaagttaatattaaatgtctatggctggtacagtgttccccttatccccaagggaaagatctttaatttaccccagaactgttagatcaattgtcccccaaataccaacagacaaatatacacatggctgtagagaaaccatttattttctctttactggggagtctcctgtgagatgattcaagtccatctatcatgttgctaaggaagagttttaagggcaaactaactaggagaaaaaaaaaaaactgatgggatggcagtcaatacccattgtggctggtcttcaccagctgggtgtgcttcagctggcctggaactgtcaaccaaaactgcaattattgaccttgctagaggctgtggctcccaggaggcagctagagagagaaaggatgatggatgcacatggtgttttctacaagcaggaggaataatttgaagcatccatgctgtcacagaccacactgccaggtctcaggaggaccataagattaaaatcataagattttggaatgaaaataggttcattgagagttcagttcaagttctcattaaaatgtttataagagaggaggaaaagcccaggcctttatcacaaagcaataataacatatcagccagggagaatgcggtgacaagcagtatgagaaaactctctaagcaatattttattccacagagctgttttttctttcagaaatgactggtaaatttcactgtaaaagatcccttccattggccataatgaaaaccacacaactacccatatatgctaaattctatgtctattttatgttttagatgtcataagaccttgacaattggattttacaatacttttttatgaatcatcttttagataaaaaatgtctcctgatattaaatgctttctattccatatcttaatagtttttttagtgtataatttctgagatataaaaatttattgagtgttcagtatgatatatttgtacaaccttaatcatcactatagtccagttattagcacttctatcactctaaaggattttcacacgaatttgtattcattcattattcctacctatgggcataagtgcccaaatactgtctctgcatatataatgttgatttttctgaaatgtcccataaattaattaataaattatgtatgatcatctaccttaatgtttctgccaaaataaaagcactggcattttttcatgtcattatttatttatatattatcaatattttattgagtaacactgaaatgtaactatatgccatatttaattatctattcataagttaatgagcaattagggaacttaaaatttatttctgttctgtaaaatgatagtctaaatattacatcgttatttccttattcctgagatgtatatcagacaattattaaaaatagtgtatgctttggattttttgtaaagggtttctcaaagcttcagtattcatgtccattacaccagcattgtttgattattagttgttctacttcattgctactattttctagtcaatagcactattgtctgtcttttgggtttgagacattttatggtgtgctgtttgatatatcagtacggtttaaatttgaagtatcttaatgagtaatgttgaatgtcttttcatttgtcatggttatttgcatataatctttagtaaaatttctacttcactatattacctattcttcaaaagtagtattatattgatcagggtacattttctatgctatatataaaagatctatgtgttctatacattttctttttattaaatattttcttttttttttccatttttattaggtatttaactcatttacatttccaatgctatacccaaaagtcccccatatccacccacccccactcccctgcccacccactccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtctctggttttatgtgaagtccttgatccacttagatttgaccttagtacaagggagataagtatggatcgattcgcattcttctacatgataacaaccagttgtgccagcaccaattgttgaaaatgctgtctttcttccacttaaatattttctttatgtacatttcaaatgttatcccctttcctgctttcccctctgaaaaccacctatcccattccctcgcctgcttctatgaggatgttaccccacccacctaccctcttctactcccccattctggtatttccctacactgggggcatcaagctctcacaggaccaaggacctctcctcccactgatatttgacaagggtatcctttgcaacatatgcagctggagtcatgggtctctcaatgtgtactctttggttggtggtttagtccctaggagcgctctgagagatctggttgcttgattttgttgttcatcctatggagttgcaaaccccttcagctcctttagtcctttcactaactcctccactgggaatcctgtgatcactccaatggttggctgcctgcataaacctctatatttgtcaggctctggcagagcatctcaggagacagctatatcaagctgctgtcagcaagcacttgttggcattcacagtaatggctgggtttggtaactgtatatgggatgaatccccaggtggggcagtctctggatggcctttccttcagtctccgctccacaatttgtctcgatatctccttctgtgattattttgttcccccttctaaaaaggaccaaaatatccacactttggtcttctttcttcttgagctacatgtggtctgtgaattgtatcttgggcattcctagcttctagtctaatatctacttatcagtgagtgcataccatgtgtgttcatttgtaattgggttacctcactcagcatgatattttctagttccatccatttgcctaaggatttcatgaactcattgtttttattagttgagtagtactccattgtgtaaatgtaccatattttctatatccacctctcttttgaaggacatctcggtacttttcagcttctgccattatatataaggctgatatgaacatagtggaacatgtatctttgttatatgttagagcatcttttggatatatgcccagaagtgataataatatgccaaattttctgaggaaccaccagactgatttccagagtacaagttgtaccagcttgcaatcccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctgagatgaaaggatggaccatgtagagactgccatatccagggatccaccccataatcagcatccaaacgctgacaccattgcatacactagcaagattttattgaaaggacccagatgtagctgtctcttatgagactatgccggggcctagcaaacacagaagtggatgctcacagtcagctaatggatgggtcacagggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgctccagtacaggggaacgccagggccaaaaagggggagtgggtgggtaggggagtgggggtgggtgggtatgggggacttttggtatagcattggaaatgtaaatgagctaaatacctaataaaaaatggaaaaaatattttaaaaggagggtagggtgcagatgttaaaatgttgcaggaaaactaaaagtacttgaactgagtaaatgattaaaccctaggaaatattttgagttagaacagtttgactcattttctatttctgtccagttttttaaaagaaaacccttggctacttccttcctagtatactttacaggataacttctcactgttccctctttcctgtttttccaagaatgtgattaatgtcagatttctcaaaaaattttcatttatatagtgttctggtaagaaaatatacattagatttcttggaaggcacatttggtttatgtacttttggtttttcattgtctataagaagaagctaaatttgcaaagatagtttgtgtctaaacagtaaaattcttcaagagtcaggcataggactttgaagaacttattctttcagcctcgatagtagaaaggataattggcatacagtttccaattaagaatgttggcaatcaaactgtgaacactgtcaccagttcaattcctctttattttccattataacactgactaattttatccactttccttcaactttttcaaatcacatagtgaagaattattataaaatagaatattgtgtttataaagcaaatatattttaagacaaagtacttacttctaacaggaagtattattttagtcttcaagtcagggaaacacataagtgaagggaaacatgagcaaatctactatcaagttacgtttgcttcatgaaatgccttgacaattctgaactattatttttccctaatgatataacccagtttataattcatttcatgttaaacagtcctcccaggcatcagggcaacaattcttttacttctttccttgctatctcagctcatcactgtgacctttaattcattttctcttttctggtctgctttgcagtcactatgaaactcagtgtctattgcggtgaagtcaattaatcacacaatgacttttagaattaagattaataatgggttatttcattgctggaatatttgatgaagacaagcacatttttggctcccctcatgcccaggaatcatttaaccaagttccaatccctccaataatgtttcctttcatgtgactttctctacaagcactacttgtatagagtagagggcttagcgaggctttactaagcttccatcagggatcccaaagaagattgcagatcactttctttggccactgggtacttcataagagcttaacatctttataatccatataacattggtcattcctctgaaagtgtaaaaagaaaatttgaaaaaaattatgagaaagccaacctaaaaagatgacatttaccaccgacctattgtatttcttagctacccgatcttccaacccccatcgttggagagaaagcttctttctgtccacatgaatgctccaaattccttagtggatcctaatatattagaaaatatgaagcatttcagattctataccacttagcttatagaaagcttagtaaaaaggcaaagttgtttgttcagtaaaccatacaagatgctgtttcataaatctgactttgcctgatgaacatgaaaaactgatcagtacttttgaaattgagttttataaattcaggtccatgcattctctccctcctctctccttcctctgtttgtatagtacacatgcacatatgtgctgtgtgtgtgtgtgtgtgtgtgtgtgtgtgtgtgtgtgtgtgtgtgtgtgtgtgtgtgtggtacttgtggacaggatacttcttgtgaagtattttatttatttatttaatttattggcatataactggaaatgtgtgtgcagctaccacagaaatcatttgctaaagatttatttcattacttcttttctattccccaggtgtacctttcctaacatctccatactaaatacaattccctctgaagtacaatatatctctgaataaatgacagtttctaaactctgttcaaaaaatatagtgcaaagccaagttcaacataatgcaacaaccagtgctgtcccagaccaaatgcattctgttctgcattattttactatcttcataatccacttcctagtaatctctgatgattgagaagcaaatcataatcacttggtagtttttaattgtgcattctagtgtgtgtgtgtgtgtgtgtgtgtgtgtgtgtgtgtgtgtgtagcccaaggtgggtttcatctctccctgagtctagattgacaggcagttgtgagctccttaatgtggtttctgggaatcaaattctggtcctctgcaaaaagcagtaagcactaaatcattctgtattaatcacaacctctttgacggttgatttactctaatgagagccaagaatggctttatctaaagatgatttttcagtgaatgaaactgctgtatctttccttttaagaagtcttgttcagtttattgcaggtagtatttattttgtttgtcaaactgtggcaccttccaagttcacgcccatgcttacaaccaagatgttggaaaatgctatcgtgccaagcagttttcctgaccagttttcaaaaaaagatagaggaatctctctactgccaaattaatcacaggaaagggaacagttcttactgtttctagttatttcatcatcatcatcttgcttttaaaaactatctctttcttatatgtctccaagttattggcagagagcttatgaactccttaagttagatgctggttttcttcctggattctatattcatggtaaatgatatgtgtgttcatgacaatcagaactaatagttttagctcacacacacacatctttttcatcagtttgtcagtcatactaaatgatatctccatagtatctagaatctttgatgtcacctcaagtatcctttaaattttagccatgtgtattcaaatcatagatctgatgatattaaaaaccatctgtcaggcagacatatccataggcagacaccacacacatacacacacacacacacacacacacacacacacacacacacacacacacacacacactcatatttgcacacatagaatgccccagtgcatcaaaaacaaaaatgaaaatttgtaactctgtctggtatattagttttctaagcttaccataacaaaatatcatggactagaatggcttataatataggcattttcatagttttaaaggctatgattctgaaactgatatgcccaggttttcaatggtcaagagggaataataaatcccaggactgtctctttgacttcctaaaggctattttcttactatatttctttacattgccttctttttacattttcatacaatatattctcatcatggttttccctcaaccacctcctcacaaatccttcccaccttcccacatacttgcatctatttttatcaaattttctccatcttaaaagcacaggtcatttggtttagtcttccaccctattctatggtgacttcatcttagtaatgatatttttaatcaccttatttacaaataagatcatatattgaggtactcatagctgagatatgaaaatatgtgaggtatatgagacgtgttaaatataattcaatatgtgattcctgacattcatattcctacattttctaaggcctttacttggcagccaaacattgtttttttgataaatgagcaattaccatcccaccttcctaaaatcatttctagaatagatttctaaaacttgatcactcttcatcctatatatacatacattaagtcatttagctttgcttatttttgttcattattgaacaaaattatcagtcaagatgacatgaacagtctatgtcatttggattattaatgtaccatgtaatgtgattccctatggtacttacatgcttcataattgcacatttattacatatcttttcttgtctaattgtctacaaatgcctaatttctgagtgcctgatttctcactatgatttacagtgaatttcagcatagaatagaaactcaatatttcttaaatgtaaacattgctgaaatgttaccctttggacaaatcaagctacttgagaattttctgttcatggatacatttcctgatgctttagcacctcactccttcagataatattgtgtatgccttgaaatccttttctttgattgcatcttttgcatcaaataatgtattctcaacatacaaaaattgattgaatacttccttgttagaggcttataatgtggactgattattgtggtatgttcaaggtaattttcaaaaacaatgggtgaaatcattctcattatttctattgttcaaaattgtcaatatgtgtcatggttcaggtatgtatatgaattcagtttctcagagacacatactgttaacacatcggaaactcctacttcgaagcacaataacctcaaaaatgcattagctgaaattccaagttttaatatgagtatcatggagtaaactatctgtttataacatttgcctttataggattattttaagaattacataaattaaaaaaaatgtgtgtcatgtggcaaacaaataacacagaaaacgaagtgaaagaaggagaggaggaagaatactaggaatagaaatattacctttataaaaatgtagctccaactttgaaagatatgtttaaccctgcaagatgcttcatgaaaaataaatttctttaggttacttttaattccctaggaattggtaccacataaattgatagaaattttatggatgaatattaattaatcaaaatattctttcatttcgtaatttgtctgtgataagtgcctctgcttttacatttaattttgttggattggtaagtgttcaagctgtactggaagaatgttgcatttcaaatttaatttgggcactgatttgttatcaagtcacactgactctgaacacctactttactcaagtatgtaggatattcattagtgcgcaaatatagttgttacatattttataacttgaggtactcaggcattttagcatctatttgtgaattagcatataatgatatgagaaattgttttaatgaaaaatttacctcagcaccactttactctgacttcagagcaaattcaattaggtttgccatagccttcttcctgtgtgcctgcagataaggcatggaaaaaaaatttctttacaataatactgctgcttagatatgataggaaagcaccagtaaatttaaaaccagcaatgttctctatgaactggaacatttaaattataaaatatcacatattgttttttattaaaatggtgacagtatttcaaaatgtgcattttgaaacaagttttatatgggttcttacggcatatgtgcatagtctccatttagtctttcaattaacatgatgagaaagacacaatggttatttctgcttcagatgtgttatgtccttagcgctagtcacgtttgctgtaataattcatcacacattctgaagtgttgctttacataaatagtttcttctgttcttcagcataatctgatgagagatgcctacacattgctgagttttctttttgaaataatatgaccatattttagttttattacaataaatattaaaaatgaattttaacaatgattcattttgcactttctgtgatgctatgaaaatatattcaaatatttaagtgctttaggactcatgagggcaattgagacttatacaatgaagcaagtagagagagtaaacaaaaaaacagtaagagctagtactaaggacactatctgatctgcctgaattaactattccatagcctgatggttaggaactgaatatttatccaggaacccctgagctctatgactccatggttttgaggcaattttgtatagtaggagataaaattgccatttgattaaacatcatataaaattattgtctcactctaaataaaagcaaaaatgatacatatattacaagtaatgagtagagctaatactattttctgaatgtcatcacttatcttttatgaagtaaccctatgcattttctctatgtacttatgaatgtacacctcctttaacacacttgacaagttgaatttttgcaacatagagtatagaaaaatcttttctatctgttttctgtaagatccattaggatatttagtacagctgttacagtagttatcaataatcattacactattgaactaataatttgaaaataaagatgcttggttacattgataatgaataaacccccaaatatcaattattcaaaatacatgattcctttatgttaactgatttttaattcattagcatcccagcaaagttaattaagatagtgtaagagttgtattcaactgtaccccttaactctgaatctgtaataattcagaaattaaggcaactagttcaaaaaagcaatccaattattataactctcatttatatgtgatatatactttttctagatactttgtaattattcacttacttttcttagtttattaactaatccttgttataatcagtcttccttatatatcaattgttcagctgtatttcagtaaagctctgactgcatttcaaaatggagaaaatagggatgatttcttacattgttctgtggtgaatagatgaggcactattgaagtatgcttgatataatgacaggcatagcagaagctatcaaggcatttttagtcaaataactattattaatgttatcataaaatctccttcagttataactattattgccatctcctacaacagagggacttctttataaagaaaaaaaacattgaatattagtagggaatcctaacattttaggagtaattagaaatttgatatgaactacttaacatttttgcacctcatctttatgcccatattagcacactctgtcttctcaatattaatgtgtcagatagcatgtactgccctattgcaaatgtaggaattcttggtcttgctagattccaaataactaaaataataacaataatagataaaatatcattagtgtaattgtgtgcccatcacttttctatgtgctctatatacattattagaaaacccaaaatgtaataagtgaagtgtggttatcctcatttatgcattatatgaagttatgttactcacacagggttaatgagttattaagtagtacagttggcaggtaagaccagtccgtcaaaccgcagtcaccgtgcttagtacattggaaacctctctatcaaagaaggactacaaataaaatataaatatagacgagaaagtgagaactgaatttaatagaaaaaaatattttcctatccaaaaagacatccaagaaatcaaaacaacaaatgacaaacatgtcatttacaggaaaatgcaagcagttaaaaataatgtgtgaattcttaccagtgtttaattatacatatgtgtattttaccatactgggcataatactcatgaccttgcacatggtaggcaagcatcctttgaactatatcctcagtctaaagtttagaaagttacatctatacttgtaagatatgtataagtattagaaacaaaaagaaaaacaaaacagacagcaaaagaaaaactgaaagaaaggaaggaaaggaagaaaggaaggaaagaacaaaaaaaaaatcagtgttaaccaatccttaattcttgaatttctccactagggtatacaaaaatccttgtttcattgatgcaaaaataaataaataaataaataaataaataaataaataaatacttgtcaagagaaactaaagtaacaaagggtttgttttaggtcacagttgtacaacatagcagggcaggagtaggaagtagctgttcacattgtgtccacagtaaggaaacaaattgtaatgaatggttactctcagctagctttttcctttcatgcagcccaggacccacgggaagctaatatctatatttagggtgagtctttccacctaaattaaaatagtctaggtaaccttattaagcagattcagaaaaatattttcatggtgattattcatcccaccaagttgataatcaagattaaccatcacagttacctaaagacactcagatttaattgtgtgaagcttcacacctgctcttcctgcagacatttccatgtttgatattaaactcaaacagtgccataacactcttctttctttgggttttgttttgtttttccaaaatcctcagatctagccttcacttttactcttcctcacctgtcaaaagaagacaatatcaaaccttttaaccccagttttcagaagtaaactgaaagcctaccattcaccaacttcatttctcctcctgtggtcctctgcctggatagctcatttgtttgttttctttgtttgtttgtttgtttgttttttgttttttaagttatttatttacatcccagttgttgcttccccctcggttccccctcccacagttcctcttcccattccctttgcctcagacaggctgcttcccccaaccccggagacctccccattccctggggcctcaagtctcttgaggattaagcacatcttccactaaggccagaccagacagatctctacttattcatgtgccatgattggccgtgtatgttcctggttcgtagctcagtctctgggagctcccttggttatgggttagccgagtctgctggtcttcccttcatctcttctatggttcatcctcccaggttctatcttccacctagtggccagctttgttttacaacatgaggtaaatcaccctttccactttgctcaacaacctctgactaaggttcccatctcaaaaaacgtatctttactatgctgttgtagactacagaagccccagaccctctcctttccttggtcataccccttgccactcttactgcacagtctataattcctctcccaggccctactctccaggcacacaccaaaaaattgactttctctttctcctagttgccttcttacttgttcatctctctacctgaaatattctgggttagagatcattatgtcctcattcctggcttcctgtctgagttttttttttaaacattgccacatgcacaggatgttttctgcagacttggcctatggcagtatcctcatactgctaattcactacctatctgattctatctacattattttgcttcatcctccttgatattttgtatgattaaatatttttctttattctgtaatttttgttaaccaataatatatgggaatagtatgttatttgctgtttgttgtttttatttctcactaataaattttcagcttttaacatagactgtcatttaaatgaacagaagaatatttagcatctcatatattgcaaaatgtatattggaataacttcataagaatcttggacaattcctgagctgtattgattacaacttataaatcttacaactttgataaaaaataattcacttttaaaagaatgtttgaaaaagtacacatcaattgaagatgaatgcacaagattacattttgaagcatcgatttcaataggaaagttgtcaacatgtcttaacagatggtcaagtaatagtcatttatttaataaaatgtgactcagcatttagaagaatagaggcaaatgtctgtgtattattaagaaggaattcctacaatatattttaagttactattcaaattgtaaggaaaacatacatacaaaaattctcccttctattcataatctgtattaaatgtttgtgaatcctaattcgccaagtgattttgctcatgcattgtttcaggaaattgtgacatcagtattatctattcacaatttcttgcactaaaaacattcctctttctctttatgtctgtaaaatactcttattttattctaggctctatttgactaatctctctactctagactgactttcaagtcaatcactaccatataattgtaatttctttgcccttcacaattccttaataacaaataactgttcagagacaacttcttgcataagcccagttgtttcaagcctgcagtacatatttttcaccttgaagcttcatttaatgctaattgttatcatatttatttaagaacaagtaataaaaatgggagtttttaatggataattgaagtattaatatacatatgcatgtttgcctttgcgtggactatctatgcaataaaagtcccagtcgaatccatatcagcaatattagttaagatcaatggaaatgtctactccccttttagtattcctttatatattttagaaggtaaaagttatactcaatattattatttaatacaaccattccgaaagttccctataccctcccttcgccctgctcccctacccacccactcctgcttcttggccctggcattcccctgtattggggcatataaagtttgcaataccaaggggcctctcttcccagtgatggccgactaggccatcttctgctgcatatgcagctagagacacgggggtacgggttagttcatattgttgtcccacctatagggttgcagaccccttcagctccttgggtgctttctctagcttctccattggtagccctgcgttctatcttatagatgactgtgagcatctacttctgtatttgccaggcactggcatagcctcatatgagacagctataccagggacccttcatcaaaatcttgctggcactgtgcaatagtgtctgggtttggtggctgattatgggatggatccccgtgtggggatctgaatagtctctgaatagtccatcctttcatcttagttccaaactttgtctctgtaactccttacataggtattttgttccctattctaaggaggaatgatgtatccacccattggtcttccctcttgattttcttgtgttttgcaaattgtatcttgggtgttctatgtttctgggctaatgtccacttatcagtgagtgcatatctaatgacttcttttgtgattgggttacctcactaaggataatatcctccaggttcctccattagtccaagaatttcataaatccattttttaaattgctgagtagtacttcattgtgtaaatgtaccacattttctgtattcattcttctgtggagggacatctgggttctttccagcttctagctattataaataaggctgctatgaacatagtggagcaggtgttcttatatactttaaatgccaatgttctcagaattatgtatttggaataaggtagataattttaataagtataacccatattttaagtataaaaaataaaaacaaaaattacgtaatgtaatttttaaaaattttatatgcattggtgttttgcttgtatctgtatgggggatctggaactggagatacagaccgttttgatctgctatttgggtgctgagaattgaacctgagtcctctggaaaagcagccagtgctctaaactgctgacatttctctccagctcctgaaactaaaatgtttaaatgttggttgcaatttcatgatttatatagatctactgacatttttatatgttttaaaattccgattaacaaaatatgtcttcaagacccatttctgaaatagtagatattattttgccattagcataataattttattatatgtgattcagcgatatggtattgaggactggaagaaaatgtcatttttaatcttggaaatattttgcttgttgcattgattttctttatttgttatattttctttatttgtgacagaatgtttattcttaaaacaaagcattcagtgaattttatatgcaatgcattttcaatttcaaaagtgatatgtataaaacaatacaaattaaaataaacaaaaatgtcttttaaaataaaacccaagtccaatctggacattattgattactgcaaacttggaatatattttttaaaagaaagttatgttcaatataggcaaatagcctacatgaatagaatatatgtaaattgcagtacggcataatattgaataccaatactctgttcaggttaaagtttcagcatcctcttttctaccttgaattcctagtggtttaaaaatttctgatttcttaacctccatgtgtactaaatgtatgtaaagtagtagaatcttttagtcctagtgtagacgtggggatatattctaattacttgaatactgaagaacttacaatgtgtctggaaagtaataaacaataaaatctattgtttatcaagcacaataattacagattaggaaatacaatcactacatagtataaaaggaataagtgtaacccaccaatacacatatatgacattaaggttaagatactgtagcgaatcctattataagactataacatagttccttactctcagtcatttacccaattctactttttttcatgatgaattttaacttttgaatacaaattaaagtaaacaaaatataagacctgcacacccctcactaaaattcaataattagaagcacaatactatcctttgtagtatataaacaatactcattttaagcaataagtactatgatataattgtttcattgactattcataaaacccatgtgttgaaagtaatattggatattgatatttatataagaaagatactattttgtttgtttgtttttgttttttgagacagggtttctctgtgtagctctgactgtcctggaactcactctgtagaccaggctggcctcgaactcaaaaatccacctcctctgcctcccaagtgctgggattaaaggcatgcttcaccacgccagggtagaaagatactctttacttcatattcaagaagcaagtttttatccaattccaaacttaaacactcaattctccatattcaactttactgagaaactttccctttgtttccttcctgacatgtctgagagaaaatgaaataatctaagatattccagtggaacaaaactatattcttcagcatagtacaactgtcagacatatttcagccagtgtaattgatattgccttatttttcactgacataatttggaatcatatatatttactttgaaatctctttccaaaaatggtagaaagtctcttgatctcaaagcaaagtgatacatttaaattataatgcgaaagcttcagtgaacttaaagaagcatatatgttcttccatgtggattgatagtattatatgtatcagaaattacagtatgaaggtagccagtatgaaaaatatttcagtgacttacatgtactgtcacatttcacttatattcatatattcttagatgctgttttgcaggaaagtctgtttccttggaactgtaaaactatgttcactgctaaaagaaattatagtctagaaattaagttcactagtcaaaattactaaaactgttattcaaaggaggaaattaaacagcaattccactcagttagggaccttataagcttcaaatagtgacctgcttgaaagatattacctttggagaaaaagtggctaaacttagctcaacactgttaatgaggccaataatctgaaactaactaattcatgggccaaaagagaaaacctactactagcattctgttaaatggacatagcaataaatgactcctaatctcatattattatatctatagattagtgtatcactaaaccctcatcagagaagtttcttataatatatgttatccacaaatatttataggtatatgtagtatatggtatccacaaatatccatagatatccacaaatgaaaaatttacaaattgcaagagactttggctcactagccctaaatgatatgtctttttaaaaaattatagaaaacagagattatggacgacatcaagagaatagcattttccagacacagtttgactggtggacatatgaacttacagagcgaagacaacatgcataagacctgtgcaagtttaaggcagacaaaacccctgcatggaggagaggaatcaggcaaaatacctcactcctaaccaagaagtaattcataactgatagctgctgagagaaggaaaaccaattttcttctatggagtgacactgggttatatcatccaaactccagtttagaccttgtacttaaaaatatttaggcaatacaatctgactctacaatttttgtctcattttgttttgtgtgtttggagagtgagagaaagaacataaagttgggcagggagggaggaatgaggaggagcatggagaagttgggggatagaagagagaaaatatgatcaaaatttatgttataaaatatttttaaatgatattataattatagttaaatttgtaaaattaaagtatatttatacttatgtcagagtatacacattcaatattttctctatgtgagatatcacatgagtctacttaaaattaaacacaaagcaactactttgtacaggacactgtactgcattaagggtcattgttaaaagaaagacatgctctcccaatagatactcttttctctactcaaataaatagatcatgatacatgcaataaaatatagtaaagagtcataaattgggtgaaaggaatcaggagggataaatggatactcttatttagatgcaattttccagaaagatattcacgtctgaataaagacttaaagaaagtgaacaagggagccatgaggttaagagaagggagaatgtgaacatcctgatgcagaaatagaacatacagataatgcagtaccaagtaaggacactgttctcacagaacttctcttttaatgatgaagacaaaagaatgaaatgcaaaattaaaaagaaaatagaccacttgattgaagttctgcagggtagagtgaaaatggacaatgaatgtttagcaagatactgctatatttcaaagctgaatgatgatctgcaaaataaagacatgtataacacagaatggttatctcacagtgaatgaaatattttttagtcatattgttgtctttgaacatgtatttaatattgtagaattactttaacaaaggaaacatgttggaaattttattgtttgagaatactatattataccaaaaatgatcaaaaggtgttttctggaatatagttctaattcaacttacagtaggatagacttggaagtggtttgcagaaatattttaccttaatatagcaaagtttttaatatctatcataaaattaaagaaaaatattcctttgtcagtactttctttattcccaagtgaatagagagttaatgatggaattgacaaaatacatggaaccttgttttcaagagaatgaagaacaataattcgatgactgaagagtcatacctgagggctggagagatgtctcagcagctgagatcagttattgctcttacaagaaacccaggttcaattccaggagccacatggcagattccaaacagtcttatattacagtttcaggtaatccaatgccctcttctggttgcctcaacacacacacacacacacacacacacacacacacacacacacacacacacacacaaacaaacaaacacacacacacatgctacatgggagtatatgcaaacaaaacacctatgcatattttgaaatatactatctaatatttgaatgttgagtatatgtcacatagagtactaaggattaaaatgtctctgcaaattgggtaatactatacttatcctaattgcataagtgtgtaagtatattgtctatataattctaaattcttaattctttaattctaattcctattcatggaattctacataatagagcactttctgttcctataatccctttatccatggcatatgctgtccttccatgttacatgtatcctaaatgaatctattttctactctaacacatttaaaaaatacaatccttaccatttataccctctgatcctggtttttagtgtttgccctgaattaggatggtcttgtgcttgacatcccacttcttaaaagtcatcaagtgtttatctgtcattaagcaatctagactgactactccaaatgtaagcaggaatcagcaccattggcagtagatacaaatttacagaatgagtctgcttgttaacgagatccccagaggttctgttggcacatttaagtttgaaaagtcttgcattaagccagcataaaaaccacttgggacttagctaaaactgcattatttataggagaacctgtggtagggtagcccagaaatgtgtgtttcttttcttcttcttcttcttcttcttcttcttcttcttcttcttcttcttcttcttcttcttcttcttcttcttcttcttcttcttcttcttcttcttcttcttctttttttttcagctgttctaggtgattttgatgcctgcttctcaagacttgctctctagggattgaaatcagcaataccaatgcattgcagtagattgctggtctgcatgagagaattttgtgggaaatttgtagagtactgtgactatacaggatctgtttgaaccaaacatatcccagtctctgaaagatggacctatgaaatgaatgcatagtttgtgtttgttttcctctgaatatctgcatgttagaaaccactgttaccgaattacttaatcaatatatcattctgcatttatttttagtaaaaatttgatctttcccaaagtaatattacaaacattaatattatgctttaatttattttccatatatgactgtcacttgtgccttctggagtccacactgtgtctctttggttttgctccatcttctaatatatatatatatatatatattcaagcaataacttctctttttctgttggaataaagaaagtactatgtaagcaacattttgaaatttttcatatgctatacaaatatgtggtttcgactttactgtatctgctactatattttctcaaacagtgggagtatatatggaggtagtttcagcttttcatctataattatggacatgtggccagaagttatcagatatcatggagacttgagcttttacttcttcaaggaaccaggtacaaaagttctaattagatacagtgtacacatctcatgaaaaagaatcttcacatgaaattttagaagatttttttgtcttgattaactgttcaataactccaaaggcacgctccccaaatcttattataggcatgagccttttgttactttatatttcccaacatggcaagtcaaaattgacactgagattatatgcttcaaacaagctacccagtgatgatgacaaggtagacccacagacatcactttaagtagtgagtatacagaaaattcacaaaaatcagaaactagtaattaatgaattcatgttacatccatatttttattttgctagcatattttctcccatttccttgttattacccttaccctatagttcccatactatttgtgcccattctctcttaattacgcagagtatatttcatatacatatacagctctataaacaatcagttttaaagttttggggtcactattcaaatcataaggttcctcttccaatcttatctcatctctaaaattcatttaacatgtctgttcatattggccagtggatattctattattgatagattaacaaaaccaacaatacaggactcttacatgatgtgtcatgcaaacataagtgttaatttttattattattcactttacatcctgctccctgtccttcatcatagcaccccatggatatgcctccaccctggtacataaagtatcttcaggtctaggtatatcttcttccaaaatgaagccagacaagacagcctagttaggggaacaaatttcacagacaggcaacagctttaggaatagcccctgctacaattgttcagtacccatatgaagaccaagctgcatatctgctacataagtgcagggaggcctaagtccagctcacgtatcctctttgtttgttgattcagtctctgaaagccccaaggatccaagttagttagctcttggttttcctggggtgttcctatcctctttggggccctcaatcctcactgcaactctttcatatgagttcccaagctctaagcctggcagtgatggtgcatgccttaatcccagcacttgggcggcagaggcaggcagatttctgagtttgaggccagcaaccctgtcttgaactcccccccccccaaaaaaaaaaagagttctcaagctccagccaatgtttggctgtgggtctctgcatctctttgagtcagccacagagtggagcctctcatagaacagccatgctagcctcctgtctgccagcattatggagtgtcactagtaaagtcagggattggtgctagccaatgggatgaatattgagttgggctggttattgcttaaccattccatcagtctctgctccatcccagttcttccgtttttgtttttgtttgcttttgttttgttttgtttttttatgttggtttttgatttgttttgttttgtaggcaagataaattttgtgttgaacattttgtgggtaggttagtgtccctatcactccactgtgagactgtgataggcagtcattcacatggccatctgtccatctcgaatgcctttctccacacctgattatgaatacctcccatttccctccccctctgttcttctaccctgtcccctccctccacctgcctcccatggcaattttgttctctgttctaagcaccctcatgtgggccttccttcttgtttaatttatttgggtctgtgggatgtatcatgggtattgtgcactttagggttaaaatctacttatcaatgagtacacaccatacatgacattttcattctgagttatttcactccggatgataatctcaagttccatctactttcctgaaaaattcatgatgtctgattttaatagctgaatagtgcttcatagtgtagatagaccacattttccttatccattcttcagttaagggacatataggttgtttccagtttctgggtattatgaataaagcttctatgaacacagttgcataagtgtccctgtggtatactggggcatcttttgggtatatgtccaggagtggtataactgggtcttgaggtagaactattcccaattttctgagaaaccaccaatttgatttacaaaatggttgtacaagtttgcaataaacaaattgcatgttattgaaaaatatgaaaaacacattggctaatatgttagaagctatgtttaactgtgatagctctaggttcagggtgaaatacatagttgggtaacattgcaaccatttgatacttgctgttatgcttagtggaaaaataaggcagtgtgttttggtttattgacagaacactaaaaagtcatgttatatgatgtttgagggaagagcaaagtgatccatttagttcatgggagctcttgtctttagctgcatatgtatcaaaggatggcctagtcggccatcactgcaaagagaggcccactggacacgcaaactttatatgccccagtacaggggaacgccagggccaaaaagggggagtgggtgggtaggggagtgggggtgggtgggtatgggggacctttgggatagtattgaaaatgtaaatgaggaaaatacctaatttaaaaaaagaactgtaaatgatgatccttagtgcagtacacaaggtggggaattcttctgtgtagacgtagctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacacctgatgtcatttttttggctaattttgtatcaacttgacacaagctagaatctttggaagagagtttcaattgataaagacgcctcccacaagattggtctgtgggaaaacctgtgatgcatttctttgagtagtgattggtatgggaagtcccatttactgtgcatagtgctttccctgggtcagttttcctgggtatataagcaagtcagaaagagcaagcaaacagcattcctctaaagctcctgcttcagctcctacctccagctttctgctttgagttcttgtcctgacttcactcagtgatgcactgtgatgtagatgtgtaagctgataaaaatctttcctctccaagttgctcttggtcatggtgctttatcacagccatagaaaccctaagacattatctaagttctttttggttttgtttatttttttctttttatgacaccttactgattgttccttgtcttttatttttgtagccctgcttttccatttccattcaaattctttcgaagtgcttcagtgttttttttttctttttttcagtgggttgtatagatagtatcctagttcttcataaaccaggcacaattcaacagaataagagagtattgagtcacatatcacacttccatacatcagagagtaaatcttacagatatgtgtccatatagaaatggtaaaatctaatgaataaatcctggtggtctattatacaaggtgaatatcattaatgataatgtatttttgtggaagaataagttttaaatcacaaaaacaaatggaaactctcacagatcaatgaaaacagtatcctaattattctgacagtggtaattacttcatgtatgtgtatatcaaaaagttattttgtacagtcaaatatattgagtattaaattgacaattatataccataaagcaaggggtgaaaatacaagatgcattggaattcatggtaaggttggatggagttcttgctgtttgtaatgcctgctttggaaactttaataaaccgactatatatatataaaatgtcagaaatgccagacttaataattttaaaacagtagatttctattaaccttttaaaaactcttattagctacaagtttggtatttattttatttaatacaatgaataaagaatgtattcattttaattttcctcccaaaactgttttataaaaatagagaattagaggcctgagggaattgtgaaatgacttaaagtacttaaggtgcaagaatgaggatttgggtttgactccccagcagccatggagaacattgggtattgctgtttgtgccccttactaccatattagctaatgaaggcaggcagatctcaagaacctgttgtctaatcaaccctgcctaagaggtaaccttccagttcagtgagtatggtactattttaggcagtggagtatatagaaatagaggaaaatatttttttctctgatctcagcatacgtgttcatgggcactcacacctgaacattcacataaatgcatcacaaatacatgtgtgcacacaggcatgcatgtcactaccacacacagagaaaaaaaatatttctattttattgccatttatttggcctggggtgcagtttggctaatatttataaggttctaggttccatcctccatattataaaactaatgactataataatagtactgatattacatatataattctgaattcttcactcaattatacattataatcttatgaattaatgtattcatatagtgaaataaagcttaaagagaatttgcctagcatggatgaagtcctgataaagttttgattgtcatgtctagtattgaaatttcatagtgaaaatacatgcagcatagttcttatgaacatatttactagaatagccttacttctgtgcagcagaaaattcatccaggcttaaagttttcttagaggttgctgatgcaaaggggaacagagctagtagaggaggatttaattagataatgctggggtttgttttcttctgccactgtcattcaagtttcaagttaattgttatgttgttagagagaagttcactgacacttaacggagttcaaagatcatctcatttaattctctgtggagtgcctattaacctctaataccttatgactggtacatccctgcttaattgtttcttaggctccctcaacgtcaaatcaagaaggcaatagactcactgtgatttattactgtgtcctcaatgtctagaatggttacaggcacattgcacaataacttagtaaatattttgcttcattaatgaatgaatatatggtcagtaaattaaaagaactttagaaaatcaaatagtaatttagataactttaaaaaatgaaagtaacccaccaaatgaattggacctgctttgatttttattttgagatacaaaatacataaacatatctcttcattatttggcttttttgcatatattccttttaagcccaatatactatcaacattccctttaggaaaagaacgttataacattattttttttacaaattacaaatatttgcatatacacaaatatatacaacaaacttttacactcatacatgtatgtgtattttataagtatcattcataaacatgtttataaaatgccatttatagtcatcttatattcactattgttagttgttgtgaataagcatctggacataaggtttccatcactgggctgggaattcccagtgggcaacaacctccttataatgaagaaaattttaaaaccagaaccattacataatagcatgattttttttaagttctgttttgactattcacctctgtgttacaattaaaacttaattttagcggacctatctgcctttagcactttgaaataactttatgagtattcaaacacatcccactttgaatacaagcatatgaaaatcccatgatagtcaaacatactaaaaacaaaagtaattggataagaatattttgatcaaaattgatcacttaaatgatacatggaatactcaatttatttctacaaggtcaattttaaagatttgcatttaatactagccactgacttcagtatattccactataatttttaagaagtggtgggaggccttaatttgatttgattccaatgacagctcactgatgaataaaatcaatttaacagaagagactaattgtagagaaaaagtaaatattacacatatagtgctcatttgcctaaaattatacaggtaatgtctgtagttagtttcttaatttcttgttataacaattggatctcattcagtcatgtttaattgctctgttgccatcactagaataatagcacatttgctttttaagatgttgaatgacatatttagattgtaatcacttattatccttctctaagcaaaccactcaatagttttagttgcaatgaaaatctgatttctactcatgatccaaatggtggcattttagctaaatttgtatcctgtatataaacttactcacttgtggtcaaactattaacttaataagcctagctagctaataacaatcttatttttctactagaatccttatgaaagttgcatcatttaacctcacatttcaaactactctagaagtctttgtttcttacttaattgtctgcattggtgtgctatagtttgaatctggatggcttttcaaatgaccatgttttaaaggttttgcctacaccatgagttgccatggacaggtgacaggatctaaagcaaatgaaacccagtaggggtaaattaggtcatgaggtgaggggcgatgtcattgaaacgaatattcaatcctattcctttcttcttctctctgccctttatggtctagccttaactaaaagcagccttttcatttaacatgtatattccatcacaaatttctgcctgttcatatattgaaaagcaacaagggctaatccaccatggtctgaaatccctgaaccccaaatcaaataaacaacttgtcctctctctctctctctctctctctctctctctctctctctctctctctctttctcttagtaagtacaggatttaggtaaatgttacagccatggagggctgacacatgaaaaatacgtggaaacttgtattagttaagtgtttttccgtgacaaaacacctaacaaaactaactttagaaaagaaaaggactcaattaagctcacggtttcataggtttgaatccatgtttggctagctctctccagtttgggggcctgtggcaagctagcacagcacagtggaaaagcctgacagagcactgcttctttcctcagagcagctggaaatggtaagggaagactgactggggacaatacttacccttcagtagtttacctccaatgacctacgcttgccaattacacctttcatcctaatgttcagcgcatcccaataatgtcatcaaattaaacatccattagtggggctagagagttagctcggtgcttaagattactagtacccaaggagctaaagggttctgcaaccctataggtggaacaacaatatgaactacccagtaccccccagagctcgtgtttctagctgcatatgtatcaaaagatggcctagtcggccatcattggaagagaggcccgttggaattgcaaactttatatgccccagtacaggggaatgccggggccaaaagtgggagtggggggaggtgagtggggagggagggtatggggggatttttgggatagcattggaaatgtaaatgaagaaaatacctaatttaaaaaaaaagtacttgtcactcgttgcagaggactggagttcaactttcttgcatccaccataagccttacaaccaannnnnnnnnnnnnnnnnnnnaaaaatgcaggtaaaacacatctacacataaaattataataaatatgtaaattttagatttttttttttttttttagaaaactaatccatcaaaggatgattctattggtcaaatcgggattcccttggggctaaactccacccagctattcttccagtttgtgtaaggaaaaaggcctaagaaatagggggtgggggaagctgcttcaaatgttattcagtgttgtcacagtccatccctaggtggcatctgcacttggcagtgttatttctatggtccaggctttagagtgatgaaggataaatgagtagaaggggttgtggaattgtccttcattgtttcagagtgtagctaaagctagacttgtaacaaggaacaccctgcctggaagtcctaaggggctacttgtgtgaatctgtggacatgaaacctatgttgttttggagtatccttagagagatgccagacccctgtgatttctgccaaggagagttgtatacagtgggcagaaccagcctgagagaagaggtaggagagagagggcgggggaatggggtgtattttatatgcagcaaataaaaggggcagagatacacaattctgtttacaaagctatggaagtcagtatttgcctgctgattttaggtcatgctttttgatcctgtattttcttactatgccatccatcattcctctctttggaatggtaatgtatattctgtgccgtttcatattagaagatataatttgcttttgtattttactgggtgatatagctaaaagattgccttgactcacagaagagactttggagttttaaactgttgagaactgtgaaagactatagggacttttgaatttggactaagtgcattttagactaaatgcatttttcattataatatggccaagagcctctggagaccaggaagttgaatgtagcttgaccgagatgtcatccacagtcttgggcactgaatacttgctggagttgtacatttttatatggtgctgctataagtttcatctctgttccttgcttgcaattcaaaatatgaggtctcagtttctgctccagttctcaagtctgcttgagccatgctttcctactgtgatggtcatgaactcttatctctttggaaccctaagcccaaagtaaacctctcttctataagttgtattggtagtttaccttaaactatgccattactagaacctgcatctatttaaataagcaaacaaatattaaaaatttaactgagattttatctctgattttacctaaataatgtttatctaatgtcaattcatattcaattaccataagtgctatgaaataaattatattttcaagctgaatttggaaatgctaaagtcagattacaagaaatgactatagaaacaggatataaagagaaataatggggtatttgaaacgaatgtaattatcagataggtagacataacatatgggaagaagtaattgaaaggatgcaatgactataacttggaataagaatagtccttaattttttcagagtaacatagacctgtacattttttattccgttttagaaagctgaaatgtatatttatgtggctctttgagctcatctgaagtttcacaggttagaaaacatgtcattagtgaactgagacacatgaacttgaacactaagacataagcaaatgcaaaggtaaactaaaaatgagtatacagatgtcagaagaaaatttttggtattgttttatctacatcagctgatgggtgtttttactttcaaatatctttcagaaacagagctccagtttcaggcaaagttgcggtttcctacttatacatctaaatcccttttgctaaccccaaaccctggcttagtgtgttagagataaggtatggcagaccaataaatcaataataattactccctatccacacactttcatctaattacacacttgagtccatctttcatatgattcagaaaccttggagaagttctcaagattacatggtttgtattctagctttaatgtttaacttgcttgaagcaatcctattccatgcattcttcattcttcttcccttaattccctccctccctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctctgtccctccgtccctctctccttcctttcttccctccctctctcttctaccccgtctcagtttcacaaagttgttagtatttctcctacatatttttcatttcctgaaagttattattttaaattatccaaataatacttttcttctttgcctatgatctcttccacattaaaatatggtttacataggtatacttttgtgtgcaactggtatagacatttatataaaactttgtaaaaaattaaatggtaggataaacagaaagagcaaatataactaataatgattatgccatcaatatgcatgtgttattacctatatctcaagtatatagctattcttaacatattaagcttatattacttacatatcaagttacatattttacatagttatattttatattaatatactcccataataaatctcattctatgcatctttatttttctaatgcaaatgagctagaagtatattaaaattcagattaatggagagagagagacactgattagtaatgctaaatatctagtgtttctcaaaatctatttaatttttaagtcaatatcatataaaaaataagtatgtaatttgccagcagtataaatctggctgggatagtgaatataaaataacagagtttaaatcttcaatgataggaatcagaagactaatatggtacttatatcttccatatagttttccataatatttcaaaatgtgaatgtttaatcagtattgaagtaggcatagctaatccctctcccactccacattgaaaaagaataaaagataaaaagcaatcaatagtcataccaagctataaagcctgcaaaccacaaaaattacaagcctggcaaaatattcccaagagtataatatgacacttgtgtcttggatataaccaataaccatctaattgaacttagggaatgcttagcagagagaattgatacctggtaatgtaaacttatccaactaattgtcactgttggactatagaggagaatctactacttctatttcttaagcaagtatattatccaactatattctaaatacttatacttttactcactaaagtgtagttttcactttgcatccaagaagctttttttggtagcagttggaaactactatagatattcacaactgatcgaaatgcatagaacaactgaccatgagatgctgaacagcttttgataaatgaacagaaaaatcctaaaacctaagtttgagggatcatagaagagggtgaagaaagattgtaaaagctagaggaggatgatacatactgtgacagtatctcttatatatgacagggctggtacacattttaaagttcaggaatgtggttgtctgaagacctaccaaataacatcaattgtcatgtcaacatgtgtgtaggaattcttacaaggccctatcaataaatgaagatttataggcacttaatagcaattaagaataggaaagtcagccttctccagagatgagcctcttaataagttgttcaatgtgatgtggtcattcttaaacacatacacacacacacacacacacacacagacacacagatatacagacacagatgaataacactaactggattcagcaggttatgtgtgtgagtatatatgtatataagaataacaaaggattcatgaattcaagaaggaataggggagcaggaaacatagaggtgtggatatgatggtatatactactaatgtgtgaaattttcaaaagaattaacttaaatttttgccttaagtttctgagaaaagaaaacaaaaccaaaaaaaaatgtctaacatcttattgaatgcatattggcctacttaaaatggaagcctctcagggtgtcctaaccactatacatacagggtttttaatgaaataaaatgaaagtataaatcaacaagtaaaacacttttttttaaagtgtacattttaaaaannnnnnnnnnnnnnnnnnnntgaggaagcagagagagagagatagacagacagacagacagacagacacacgcacacacatagagcaagaggatagctatagtgaggttttagaattgattttactaaggcctcagcagttaaatgtgaatgatagatggctgcacgtatacatctgtatttgtattttatatttgtatttgacctatagcctcaagttgtgtgtgctgcaatgaattccatctgatgtgtatgtaacagcagaaagagtgaatcacagttctaggagaagttccaaaatgaataaaacataaacatcatccttgacaaattcacaaggctgaaataaatatatgccatactaagctcctgaggaaataaataaatatatgccatactaagctcccgaggaaagggaaaaaaaaaatgtgagaagaaagccattttccgacacacagaaccagagtagttgacaaacatttgaaatttaagtgagtttttatttgccaacaaacataattctcctatacaaatgatcattttctaatcatatatgagcagactgaccaaaacacaagtcatctgcaaatactcagattcagtcagatgctcttagtacaaatatgtactagtttgtatgtccatggtttctataaaattaaacatcaattgtaaataatttgcaaagcatagcttcaaatttagaattgattattgtttacctttttgttgtacataaaaatacatttataaaagacctacttctttttccctaagttagtgttttctttaatgaaaaccctttgtaatttgattttttattaagtatctaagtattaagaatctaaattttattaaggatctgaattttcatctatttgattataataattttgatataaaacaaaattaagatttttcaatattagtttcttaggaggatatttggcatttcataatatttttctcgttaatttggtcatgtatttctgtgcagattgatactagtaagatgaatggttatgaacaatataaaaagagaatgtccaaaagtcatgagacagtgctttatgatgttaaccacttaaaggggtataaaatgtgtataaaataacaatttaatgaaatataattagtgagataataacttcaaggatctgccagatggaatttgattttacataattaaaactgaaaacaaagaaaacgggaaaggagtgcaaaaaaaaaggaaaagaatacaaaataggggaggagatttatgaattgatttattagaacagacaaaagaaagagagttcataggaatttcacactaggatccatcatacatcctctggggtagaagatgaagtctgcaatcaccctgtctaggaaagggataggtttgaaaatatccaagagtgagaataaggaggtctccctcatctcttcaacaagtagtaatatagagtgacagaaaaatcatgactgtcaaaggagagataatagagaaactgaatctttattgatataaatggccaactcttgattgaacatgtcagcgtcgttagtatcattggcaggaataaccttgatgcctgccaaataccaagtcaaccccttctctctctctctctctctctctctctctctctctctctctctctctcgcgtgcgcgctctctcttcatctctctttctctccccatctctccctccctccctctttctttccctcccttgcttgcttcctcctgccctctccccttgcatgtaagaccatataagaagcttttttctacttattcaaacagttctttgtgttaattagagtgaatcattgactttaccttgaacaacttagcaattgtgtaacataagttaaaacattttttaactgaaggaaaggccatccagagactgccctacctggggatccatcccataaataactaacaaaaccagacattattgtagatgccaacaagatcttgctaacaagagcctgatatacctgtccccataaaaggctctgccagtgcctgacaaatacagaaatggatgctcacagccatccattggacagtgcacagggtccccaatgaaggagctagagaaagtacccaaggagccgaaggagtttgcagccctataggaagaacaacatgaaccaaccagtacctacagagctcccagggactaaaccatcaggcaaagtgtacacatggagggacccatggctacagccacatatgaagcagaggatggccttgtgggacatcaatgagaggagaggcccttttcctgtgaaggctctatgccccagtgtaggggaatgccaaggcagagaagcaggagcttctgcaggggtgaagggttagtgatcagggagagggcagaagggatagggggtgttttggaggggaaatgagtaaaggggatatcatttgaaatgtaaataaaatttataatttaaaaaaagaaaaaaacaataaaatcaactgtataacatagtttcataaaatattacattttctcctggggtgggggaaaccctgctacacagattttatttacagataaattactctaagtgacagttatctattcttcatatggaaaataatacaagcaactggaagaaaagcaaaggctgcttaaatgacactgaaatgcacccagcttattaataaattaatagttatttcaatgttagcaaactgacagtacaaaaaataatacaatgtattatccctaacaaaatagcagggaaaagaatttcttgaaaataattaattgttgcatagctgctatgcaagaatattaattactgtcaacaactgttcttactcaatcttcttattcaatttaggaagtatcaattctttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcaggaagtatcaattcttaataagaaaatttcaattaaatggcatattaaatatctgaaatattgctgattatggccatgccatgagctaaaatcgttatgtgtttgtatctaggagttccaaaaagaacaaaaccaaaaagccaagcatgtcatatgggataaaaatacacaaatggacaaaggaaatgtagcatcaacatataggaagttgtatatttaactaacaaattggctgaaaataaactaataggtctgttgagtgtcttccctaaacatatggtgaaattaaaaaataaaatgatgtaatttctgaatacaattttgtatgattataatacttattttaatgcattttaaactctgaaaaagaatagcaaataatattgctcagattgctagactgtattgtcttatgcaactctcatgcttgtttattttgaatcctgaagcacctgtaatttaaaagaataagttactgtttcatgaatgactacagttgaatatccagcaaagtacatatgattcagtatcggttgtgatcacgtagaagttttattgggttttcattggaaagtttacattaatacattgtttttaactgcttaggtgggatgagcaaaagatgacctgaagttagaaagaactgatatataatcaaacatatattgagtgatgtaaaagaaacacagaaagtcaaatatcatatgctctctccaatatgtggatgttaggattgaatctgtagatatgtggttttaaattagagtgcctgtagaatccaggaaattggaaaggactaatgaaaacctattactctctaccactctctctctctctctctctctctctctatatatatatatatatatatatatatatnnnnnnnnnnnnnnnnnnnncacccattttattgtgaattcaccagattaatgatgtacacagccttcatatttgttaacaaataacaagacagtgcaatgaaatagaacaaatacatgcacacacacatataagcacaaataagcacacacacaactttatataacaattacaagaggccatgaatttgaaagagtaaggaaagatagaatggaagggttttaagagaagaaaggggaaaagataatgatgtaattatattttgatcacaaaaaattgatttaaaaattatgctgtttctctgatttaattattaaagaatattaaatttcataaaaatgttgagaataaaataagaaaaatcatgacattacatcacgggtgatatagccaatgctcattaatggtttatagataagaaactctacccttttgtcttaattctgtctcagttaacagtagccttttgcagatttagtaaaaaacattatttgtaaaatatatgtttttaattattattaaaattattattattattattaaaattattattaaatgtaatattttgcatcgaggaaaacttaaaataataaaaatatagaaggtatgatggaaaaagtatatttttatgagctagcatcatgagcaaaatatataaaaagtagacatatgtcattatcagtatctaaatgtaatgttttttattttagtatcagtgccatttgctaacattatttttgtactaccaatgcattctgagtacttttgttaagtatcctaacacctcaatttaaaggcatacatttttgtgttacagtataattatttaatcaataacttttcagttggtggacatttaagttgattttgatctactgatcaaaggagaaagcctgatggtattaaagaagctttctcaaaatgaatgtatatattccataatctaattttgtactagaagtatatatttgttttatgtatcttcaagcaaacacagattatattctttaaaattgtagaatcatgttaatatactgattcaagtggttatctaagaaaatttaatgcattctggaggaaattagtagatgcctgcattaaatcctaaatttgaatcttgaaataatagctggaactgaatatgactgacatttcttagcatggatttgctattttaaaagagacatatatattcatttatgcttttgaaaggagctgagtactttatatagcatttcacatgactattcttaaccttaattaatgtaaaaatattttggactaagttttattccaggagaattaaaaatatacaaagtataccaaaacttgaccaaatttcattaagtgaaaaacaatctttcctaaatttctggaaactttttaagacttgagaatgtttcacaatttgacttaatatttgcatatgtccctacacctataactctgtgtagagaaatatacatcctttctagttatttagaagtggctaagggatacactacaatcaggattttaacaaagaacagttgattaaatggggaaagtgataataatgtcacaagtttaagaactttgtatatatgtataaaattgaatagactttgttgataccagaaaactacagaagtttataggagcaacctgctaaaccatgaaattattgttttagttttccaaaacacaagaaattgaatatcacatcatatatgacttcaaatttttcttcaaacatctctctttgttttcagttgagatagtttaaattaacataattaaacatgaaagagatgctttcattttaaaacatttttacttttaaaaataatagactgaatattacactcaagttgtactgtgtttatgtaaatgtctacatcatataagaacagtataattgttcaaagatcaaaattaaattttagaacctaaggaatcatagtgaatatcaatgaaagttaaggtattttctatgaactatggtactaaaaatttaactgaggttacagtggatttttttaattaggtattttcttcatttacattttcaatgctatcccaaaagtcccccacacgctccttcacccactcccccacccacccactcccacttcttaaccctggtgttcccctgtactggggcatataaagtttgcacgaccaatgggcctctctttccagtgatggccgccgactaggccatcttctgatacatatgcagctagagacacgaggttttggggtactggttagttcatattgttgttccacctatagggttgcagatccctttagctccttgggtgctttctctagctcctccattgggggtcctgtgatccatccaatagctgactgtgagcatctacttctgtgtttgctaggcccccgcatagcctcacaagagacagctatatcagggacctttcagctaaatcttgctagtgtatgcaatggtgtcagcatttggaggctgattatgggatggatccccgggtatggcagtttctagatggtccaacctttcctctcagctccaaactttgtctctgtaactccttccatgggtgttttgttccctattctaagaaggggcaatgtgtccacactttggtctttgttcttcttgattttgattttcatttgttttgcaaattgtatcttatatcttgggtattctaagtttctgggctaatatccacttatcagtgagtacatagtgtgtgagttcttttgtgattgggttacctcactcaggatgatgccctccagtccatccatttgtctaggaatttcataaattcattctttttaatagctgagtagtatagtgggatttttaaattgttatttgtaatacagctatttttataacatgtattcttccaatcatgagcatggagcaaggaagaacttttcctttcctaatggcctcttcaatttattttgagtattttactgtagagttctttcacttctttggttggtttcattctaaaataatttttaggcaactgtgaatgggattgttttcctgacttcttttttgacatacttgttattaatatgtagggaggttactaatcaccactccttgacatataccttaagaactctatatcctgccacagagacacttgtacatttatgtttactttcactctactcccaatagcaagaatatggaatcatcctagatatctatcaaatgatgaataaataatcaaaatgtggtacagatatattatgaaattttattgagccacaaagaaaaataaatttttcaggaaaatttacagaactggaaaatattataaatgaggttgcccaggctcagtaagatgaatactatacacactttctcctatggtactcttaactttctaattttcatgtatgattatttatgtggaagtgagtatatgcagtgatcaggaaaccagaaaggggcctgtgagaaggtaaaagattcttgaggggaaagggtagggagagcaatcgaatatatgtgatatgaaaattaaaatatgtatattagtgttgagaggatataaacaagcctagggaacagggaactaggagagagatcaaaagtcaaggaggccaagaaaaaatgactgtgtaagaaaatattataaggagagctgtggctttataattaacaaaattttaattaaacatgtttaattaaaaataaattgtgaaactggtcactaattgaacttaaactggctttttaattgaataaactttgatattcttgggaaacacaatacaatttattttacttcatttttgcaaatgccaatgcagtagacactgtaatttctatatgtagacagtgacagcatattttctaacaataaaacttctcatttacatgtattgaatgagaattatgcttagtcattttttcccctgaggannnnnnnnnnnnnnnnnnnnnnnntacattaatttttaataccagttgattatttctggcaaatatttttatggtattacaggcctttctattgaaaggtaacagtattctgggagtagcaatattagttttactgaataagcattttatataaaatttaagtcatcaatgctacatatttaggagaaatggtggatattcactagttcatgattgaaaatttaaaagtttgttctacataaatttacattctattcctagtcaccataaaaacagaatgttcaatgacttttgatgtcctactgattgatttttgcatttgtttatatttgcttgagtagagaattgaagaaaacagggttcttgtgcaccaccagactgactgaaaactcactatttagcctatgtggaacttttattctggaatttctggctactgcctcccaaatgcagggattatatgcacattctaatgattagtggtaattgaaagaaccaaataactcacattgaaaagacccgatgaatgatacgttttttcctaatatcatctcttagcttaaatcgcctttcaaattctaatattatggaaatgcttgtacaaacttgatatgattcatgtgtatttttttttcttttaggctttgaaactgctccatggatgaaatggagtttaaaacttccataattataatttaaaatgattttgttttaataatgcaatatataagcaattctttgggaatttcatacaatatatttttattatattcaactcccaactcacccaactcctctcagaccaaccttgcctctctaatcccctggaatacttcaaaaatgtgtctgcaaaatgtgtttacaagggagttgagattcccttgtaaattcagcccagtgggagatgaattgcctaagaatctggaggtgttggatctgatccccagcaaccaaaataaatattgcctacagtttatgaatctgtgttaaatctgcttcataataattaaggaaaatttgaaatgaatgaaataataataaattttagttaagaaaaatattgaagaggtgaagacatccaatattttctataaaagtatgaaaatgaggggccagtgagatgtcttggtacatgaggaggcttgccaccaagctccatcagagcctgagttcagtctctagaacccacatgatacaggaaaaccatccacgtacacacaaaagctaagtaaatggaaaaataatacaaaaatttacataaaatcagcactttattttacctagattagtggttcagagaaataagttctcaaacaatatcagttttatgtaatattgaatataacataacaagagaactcaataggaggtcccaaggcctgacactattactgaggttatggagcactcacaaaaagggaactagcatgactatcctacaaaagactcaacaagaagctgaaagagtcagaggtagactctttcacccaaccagtggacagaaggatctgacccctgttgttgaattagggaaggctgaaagaagctgaggagaagagtgatcctgtagtgatccagcagtatcaattaatctgccaacatctttcaaatactggactaccatacaccagctgatatgagtccccaacacacatacagtagaggacttccagatctgtgttcactcaaagatgatgcacctaaccctcaagagactggagatcccaaggagtttagagttcaggtggggtgggagttggaggcatccatgtggtgctggggtggggtagggaggaggtgtgggatgaggagcagtcggagggtggatagggttacagggaatggaatatagagtgtaaaaaataaattaattaaaaaaagaagtctcacagccacagaaaagtgttaaaaatctgttccattaaagatcattcttctctgaattaaactaatcaaaaatatattcttttatttttctggtttgcactttggtaatatacttaaattttgctgttacatatgtgtgtgtgtgtagatttttctatcagtaaaatgctaacataatcctatcttaaattataatattcatttatctactacttatttaaaaatatacaatacaaggttatgtacatataatatacagtcaaatataaaaatatatgcctgtaatcaactttctcctgatacactttagtttaattttacagtatggctccatcgttatttttgcagccatctctctaaaactccatttcagagaatgatgactatctggaactttttgctaattgtctttgatggtcactgtgtttttattccatggcattaaataagttaggaatttaattttagaagatataatattgtttatgacttattgtgctcttgaatattgactctaccccaaatgtcctgtgaaataaaataacaaatgcatcctgggaaattattttaacaaataattatgtttagcaatcgcttgactgtgaaggtaaaattttgctttctaaaacacccttccataaatgctaatgtatgtgactattttcaaaaagtaaatctgataatcacttggcaaatcagaaggtcacttgtctgtatttccaaagtgaagaaatagaatttttatgaactcttgatggttttcttacacagaatattcatggttgttaaaatgctttgaaaacttagctagtaactttcgtgtgcccagggagatgagtaagatgaagtgccatcgaccaggcactctgtgtacattaagcagtgtctgtgccacatgaccttacatatactccattagtttattcatttattcagtaaacattttgatacattctttgtgtcaagtttttttctaagaattgagataaagcagtgaatcaaccagatgaaagaaaggatcaaaatcttcattttggaagaactgaagcaataaatatgactgccttcgaggtatatgaaaattgagaaattctgtagaaaataacgtatgacctgcttctccaatttcaatatgcatgtgcatcatgtagaaatcttagttcaaggaagaaagattcagcaagccttgtgtagggagcacagatttaagattctgtcaagttcctcaagaatatctattctactggtttggaaccactgatgtagtggcaaagtatagtcagtggaatagagatcaacagcaaaagatgggaaaggaagtgactgaaatttccaatgtgatgattttggttggcttatttatgagttagtaattgggcaaagtgggtgagggattttagctaatatttataaggaaataaaacctaccagtacttgtcttatttttactacgaaagtctttaaaagcaatatgaactagataatgggctggatgtgaaaacctagagttcagagtagaagataatgcagaaggttgaaattttctatcatattctcacattaactttattcatctttatttctcattttaaactggaaaaacatggttagaggatgtaaccaactgctttgactggtcagcagtagactagaaactccaaatatcatcaactttgtccagtggtagctataggcacagtgacctgtgctgtagctaaagaatcatcacagatcactgtaacatgttaagtacttgttgacagagcaagtcaaaaatgttttcatgcagaaacaatgagttggactttcatcattctagctgccttgcttagctactgtagacagattctttgaagtcagtacttgacagcttttcatttgttctagagaggcatgttcatctgggtgtgactgcttttattcattcacacatcttggcaatggcttattataattaagaaaagcatggggttagtgatttgggataaagaagtctacactttctggggatttggaaggatggggaagagtaagatgaatattgtggccttgctgtactacactggaatagttacaaggcatgtgctaagtgatgtctcagaaatccctagcagcaaaactgaaattcaggttttcacagaaataccatgagcttcagtatcattagtggtgtgtgtgtgtgtgtttgctttctcactttacttcctttgttcttcagttatgtttacaatctactcaaaaggaaaatatttgcactagagtttgtgcttctggataagctaagaaaaataataatgcaaaatgtgtttaatgatctatccaggatagtacttaaaagaactttcctaaatactgccagatagagtctcaaaaataattgagctaagaataacttcaaatttccttaatgattgtgaagtcatatctatggttatgtagctgttattttagatgaatatattcttaagactatgatggtaagtcccctcatttcctctaccaaaagtatgtctttttttctttaccaaagcaaatgttcattagattttctgaatgtacacaagtctctgtgtgtatgacactgacacttaaattgcaaaaatatacacatacactcatatcactgtttacactcaaaatcatcattttgagtcctatatatgaagagcatgtttgacattctgcttacttatttataaatttggtatgcaagcattttccatgtagatggagaaaggatgatatctgaatatggtacaatgtttacagatcaccctttggacattgcattatattgttctaacagtttagactgcaatccattggttgataaatatgtacattaaaataaacttcaaaaacatctcattaaaatgtgactcaaaggattaatcaaaacagtacatttaaaatgttataatttattagaaaacaatttcatttctttaagccccacttagtgcaagcagaaatacagtgaactagtttttaaaattcaatttaaaaacgtaatttccacaattacttctattttgagtaattagacattatagttgaaaatttcaccattgacatatttaatgtcataaatctattgtcattctattgtactggaccaacttctcatcagtacattaacaccaacatgattataaattagattttagttattaataccatttcaccattattagtttttcttccttgttgtctcattctgttgtgtctcaaaatacattatatggatgatgatgattatgttaaagcatgaattttctgaactgtcagaatcatacccacctacctacaagatcatttgtggtagcaaaatacagcaggaactttatcacttagttctaatatatagttatatacttgtattcctggctcatttttggagatactattaccagggcttttaagaaccccaaaagaattttctgcatatgatcaaatattgagtcaatttgggatttttacagtattttaaattttattctacattcttcattacccagtaatgttaaagaggtaaatacagtttttatctcaatatagtatctttaaaatatgttcttttccattttctttttttttttaataaaagttagcttttgctgccgttttcagtgttatatatgtcccctttcttgtaaaagaactaaggcagcaagcttactatttatgcatgtttgtgagtatgaatatttttatgcacatatgtacaaataggtgtgttcatggatgacatatgtcatctttggatatcttcttcaattgctctttaccttaatttaagacaaggtatctccatgaactaggagcccacaaattgagctagtctggatgaccagaaagctctagaggtccttgtgtatctatctctttagtcctgagattgcagacatgtatcatggctgtgccccaatttttacttggtggctggatattctaaatgaggttttcatactttcataccaatgactatatttactgagctattttcccagcttctatacagtcatgttgtgggtattttgtatatagtatattattactgatgttaagtcactaaattagtattttcccagagctgctttggttctgaaaactgtgcaagaacacaaaattaacatttaacctaagcagcaaaagctgtctgattatgtgctgtgctaatggattcacactgataattcaaaagatttagacccagctctttttgaactaaggggagcaaacattcaaaaataaataaaaagaacttactctttactatatagtactaagaagagataaaatgaattagaatgtggattactttagagacaatatcaatagattgcaaatatcagtgttttatgataatattgtatagaaatatgtttttcattctataaattaagttcagagaagaaaaattaggcatgacatatctacttcatttagaaaaaataagcaatatatggtaatgaaaagttttgtcaatatatactattgatatactattgagacaaatggtaaagcaatatttttcaaaaaatgtgaaaatctgacatgtgcacagtaatatttaataaaatgataatggacaaaattttagtggtcaggatattaaaataactttccatataaaatataattatattattggggatagaaattaatatttttggtagaaagctgagtgtttggatctgatataagaaattatttcctaagtatttaagattttcttcttgaaaccctgaacatattttaagtgcaaaattttgagataaacactgaagtcacttagattaataaagaaagtagttccttagtataaaattgactgacatgtgtacatatatatgtatacaattttataattataaatatatgtttatgggaataaatttttcatttataatgttatatgtaatcttgaaggatgtgagttgttgggtaagatcaagaataagaatatgcacactctatgcatacatttattttataatctattgtaggccctttgtaaagttgacatttgtaatatacatgtctttcctcacaagcatatagattcagagttgttttactaagtagaccagaacagtaggaagaaaatgaaaagtctaattttgtattgttcaaaagtcattttcataaatgtatactagacattatcagaggtgccaaatataatattttatagcatcttttattaaataaagcattaaatgggaataatgtccatcagaactggatagtaaatcaaaacagaagtgaacatgtcatgataaaatgtgagctacggtgtacaattaactaaaaactaaaaagttattaactgatgggaaagaattagtgaaaatcttggaatacaaataaatatgggatataaaataaggactgtgggattcacatatttagaatataatacaaatactataaactcccaaaatctaatttaataataagactattttctcattttcacagtggaaaataagtaacctattttataatttaaagtcttactgattttgattatgttgactttataaaagtaatttatttattatccatcgaatattccacctgtaaaacatgaacatatatcactaaaagtataacttggtgaatatttatttcagttacagaacataagtccattagggatgacagctatctacttcagtcacctatttggaacacccagcctctgcatgaatgcagagttaaatgctgatttgatggatttttttatatgacatatttagttaaataaaaagttggcattatgtaacattaatatcatgtaatgttttataaaaagtgacacatccaatacagataacaatttcatcaattccacagaagtttcccttcagaatagttagaagtacatgagtaaataaattggatatgtgacaatgcagtgaagtagaataatttttaaaatggaaatggacatattaagttatataagaattatgctaactgttaattaattatggatacattattgctcatgaatatgttactggctcaactgaaaatcgaaatcttttgacttcagcaatattcttttctttattattttagctcattcatctaatggtttgtttgacagaggaagaatgtaatattactctattatatattaactgcactataaatcagcttgttaccaattaaatattttccttacatatggtaaaagagtccaacaaatactgaatacatctaaaatatttattttattacttttaattatgtttatgaaagagaatgccaaatgtatgtgggtgcctgctggaaccataagaggatgtccttggacctagagttataggcaattgtgtgcctccaatggtagatgctgggaagataatttctataatttctttcttctggaagaacagcaagcatttaacagctgagccacctctccagtaaaatactcgatgcttttaaatgacagagaaccataaaattacttttattttatcatttattaggttttataattatattatagtgatagaaaatgttatcacaatatgactctaacaagataatgagcccatattgtgataaatcagtagattgtgttctgtagatattcactaaatgagagaactattatttattttctttcctattatccaggataatgtccttctcatagtaaaggttcaataaacacccactgaacatattgacttgggaagaagtgagaaagatggaccctctaagatgaatttaaagtacaactggagtttttctgggaaatactgattaaaatttaaatcacatatgatatactagtaaactcagatgccaacaatacagttaagcaaaaaatgctgacactggtataaacaaaaacaataccatgtcaacaataaatgtcaacaatgcttaagtggtagtaactcttaaaagacaactcagggaaattcgatactggaatgttccttttcctatttaatcattttgctacagaccaagagaggcacagatagaggctctggctttcttacttagcatacagacatcctagtttccagtaacttagtggatcttttacccatgattcaatacatacctcttcctatttggagactagtttccaaaagtactaagttgaatttccttttatttgtactaaaatactctcaaatttgaaaggaacctcaattattccatgtagtttctcataattctattatttccaaacaggatcaaaatccttggcagcacatccacacactctttggtcacttgaactgtgctttctttacttcttattccatgtgcagatctttcttttttattcatcattttatttgttcacatttcaaatgattctcctcatcctatccctcctcccctttgcctctacgaaggagatcctttacctacgaacctactccaggctctcctctctagcatccccctatgctggggcatcgaaggaccaagggcttcccctccaattgatgtcagataagaccatcctctgctacatagatatggagccatggctcctaccacgtgtactctttggttggtgatttagtctctgggagttccgggtggtcctggtagttgatattattcttcctaaggggttgcaatccccatcaactccttcagtcctttccctagctcttcctcttgtgtctccctggactcaatcttatggttggctttgagtatctgcatctgtatttcttaatgttagcatgttaacatcccttctgagctccacacaaaagttaccaagcaatagccaggtaggcttggcttgctataaagggggttgtttggcctctgttaactctctctgatcctttcctctttctctgactcctttccccctctgtcttctttccctaccccgcctctaccctcttcccttctctcttcttcctcttcccttctctcttcctcctcctcctccttcttctttctctctttccctctctcccccaacttcccctctctgtcctctctctttctctgtctctactcccttcccaactcctcttcctatccccctatgtaaattctactctatactagacctttaatatggcttgttccttaagggggatgaacacttcagtatatgtgcattgaggtagcccctttccaccaccacactataccatgctccacaaacatatcatttgttttacaaaacgtatcacttgaagcatagcaaatagtgttgtactgggtttccagctgcagtttagtctatcattgtctgattgactcctgttgctctatagtcttccattcagtctactctatctagaattgtaaagtcttctatatatctcatcaaaagattcacttcttgatctctttttctctttacttcagttttagaaggtccatatctgtcataattctcatagcatgaaaagctgtgcacatttctccattctttggctttcacttgatttggaggatttctcatcctcctgtacaaatgggtgccctcaccattttcctttctaattctctcttcaacatcaccaacattcttaaattaagcataaccaatcctcttagatatcaagtgtaaaacctgaatggaatgtatatatcaacagtaatatcctaatgaccaaatatccaatgtaaacctttagaccaccatgtcaacacattcctgatgaacaaaaaatattaagggatgaagactgaggtacatgacagtatacatgagtcccatccagcactgcattataaactggtacaaaaaatttctgttcagggtagtaagatagaaaatgtggttgtagaaacatgttgtagagaaaagaaactagacagacatgaagacagaatgagctggggaatgagaaggagctagaagacattatttacaaagtcagtatgtggtcaggcagtaccattcagtcagaagccaagagaagctggatttaattaatctgcttggaagattagattttacggaggctagaaggttccaggcctacgcctatgtatagttagaacagaggagaaatgttctgtactcaggccaagctatgtattcccaaagcttgagtatggctctcattttatccctccatcaaagaaaataaaagaaacattaacaattaatgctgattttattaaaattttaagataggtaaatggatttgataaaactcttcatttttttacttctatagagttctccatttatatacaactaaagttgtaccaactgaattttgttaatatatatatccatgtttaatttaatgttttttctaaaatcatgtttattttggtatacaaattacagagacacacggagttattattgcctgacttttgtttttacacgttttagtttttaatatttcttgatttttatatatacaaatattatcttgtaaaattaaattaacttttcaaacaagcaacaattagtaaaactaacatgagaaccagtacagctttacgaaacatcattttataatgcaattgttttaaatttcatatgtattctagaacaatgtcatctctactatatcacctttaaagtattttaaaacaatggataaacatgccagcttttcactattattttgtgtaaccttcaatacttgtttcaactttatagaaacagctactgtcacacaactcagttaattgataaaattctaacataaacactatgtacaattagaacacattgaagagaaattttcatccagcaacatggctgctctagcaagggattacatccaaagacctgggtctatgtgatctggcaatcacactgacatacatttaaaggtaaaattagtttgtagaaggaagcaatcatgtttgaaaatgacttctaattgaggggcagagaaagtaataaatcaaagaatgatttgacagaatgagtcagagataggctatgccaactcaggagaacagccacaggaaaagagaagctattaaagagcagcgcaggaagaagggtgggtcagttgggaggcagtgcagtgcagtgaagttatgttcatttgtgagtgcatgcagttcaatgtaggtcagcagaggcagttgaagccagagaccaagaaggagtcagaaggttagaataaattgtcagagttagtttgaggccaagcagagcaattcaatgagaagctgagagaagccagattgaatcagtcagcttggagaagagtttgagcccaaataactgagttgaaccagccagccagagttcaggaagagctaaaaggggtgaacttattcagcagtaggcctccgagataacaattatgtttagaaaataaaagatacttttacaatatatgatacattttggcaaataatagatcattttgtgaggatgagttcactcataatttgccttttcactagagtgaggaaagaacctactttgaatattctatacactctccaggctcaagtgaggttagttccgatagtttaagactgaaactgaccatatctgttttcatcagccttagaaatcttgctctgcaccatttcttttcacttcttactttcctgacaggtttatggtaagtagtccatgaagaacataattacaacctgagctttatatcatgaatatttttaacttccaatggaaatacattttacagtaaccaattctcagtttattatccaaaaatatgtatgcttagataaatggtgtagaggaataatttgactaacacatttttgtagtcctttcaaagttcatttttatttgcctatgcattttccctatgactcaggtcaactatcttaattaggtatttgactggcaacatcttgttaataggttttcataatatatataaatattagattttctagtgattatttcctgaaattgttaattgttaatcttatctggtgagaataataccactgtcacatttttagccaagtttgaagcaagctttattaaatgttgaccaggatgaacagatactggtcatctccatacctgggactcacaaagtgtagtgctgaattatactagtcattatttgtgtgtgtgtggggggggtggttagagacagggtttctctgtgtatcgctggctgtcttggaactcactctgtagaccaggctggcctcgaactcagaaatttgcctgcctttgcctctcaagtgctaggattaaagtcacatccttgtaattgcaaaaaacaaaagataatatacttttcactttaatctaatcagggacaaacacacatgcatcctgaaatacttcctgcttataaacctcctgcctctgtgtgcagttgatgtaatcaaacttgtttatagaagcaaaaatatatgttttttttaaccttacatgagcaacagaccccagaattccagtgagttatctgtccttgagcaagtggggattacattagaggcatttttgtttatagatctcttaagcacagcaattaaaacttaaaatataacaataactctcacattatctcagtaatgctcaactcttacataaatgtgacatgtattcctttaattagatatctcttctcacataattcttataccccggatatcattttctctcaacattttttaatctaaataatctttataagtgtcaatcaaacacttataaattctgttgatcaacaggtaacataacacagtgtactaccaaatatgtatctaaatatgtcctacacatgatttttacctcaactctattggaaattctctaattacaataagtaataatatgattgaattaatagtattccaggaggtactaaacatactggatacctacatacaaagtagttggtaatgattatttgacagtaacacagaacacagatttcaggattcatttggctgatggacaaatatatagttgggcatggtggaacatacctttaatcnnnnnnnnnnnnnnnnnnnntggaacatacctttaatcctagcactcaagaggcagaggtacacagatctttaagtttgaggctagctttgtctacagagtgagttccaggacagccagggctatacagagaaaccatatctaccagaaaagaaaggaaggaaagaaggaagaaaggaaggaaggaaggaaggaaggaaggaaggaaggaaggaaggaaggaaggaaggaaggaagaaaaatccataatatttatatagcatttctggagtagattctaggctatactgaattatgttaatgatttaaatcatccaaatagaacatatttagaagaaaatgagagtttcacttctatactggaatatgactcaaagcacacaaaaataataatccatgggatagattagaagacacaactcttagttcatgtttgtaagtattagcccatctattcttgatccacctaatgttaactagttgacaaacacagccctattttttcctgtccatagaaatatgtacatttctaagtttaggtactgactggtaagtccacatacatttatagttattcattgtgttaatctgtagatttccctatagctataatatttttatcttaagcataatgtagagtatttcatgtttaatatatatgtaggaagaaagatgggagaatggatagataaatggatagatgagaaagaatgaaatgaattccaaggccacaaaaaatacattccatcttagtaaagtaagttgtttcctttatttgactgtgtggtcctttaatcttaaggtcatattagatattacctgatccaacttcctcactttataagtacatatatggaagtatttatccaactttacataatataatgtgagtttctgccacatccatcttagaaaaatgttagttgtttaatattgcagacagtaaacaaaagatgtattaaaaatttgttagtccttttccctttttcattctcagttttctcatgttttacacttgtaaaaagaattattctttgtactgcattatagtcacactttatgttccatagctctttattttctgttgttcctaaataagatataaagttcatggaaaatgcaattgcaatgatacagtcaaaagtaaaccttgaaaaacattaatgtcagaaagtgagaccatagtgctctcttgtgaggctatgccagtgcctggcaaatacagaagtagatgctcacagtcatctattggatgcaacacagggcctccaatggaggagatagagaaagtacccaaggagctgaaggggtctgtaaccctataggaggaacagcaatatgaacaaaccagtaccccccagagcttgtgtctgtagctgcatatgtacgagaagatggcctaatcagccatcaatgggaggagaggcccttggtcttgtgaagattatatgccccagtacatgggaatgccagtgccagtaagtgggagtgggtgggttgggtagcggggcaggggaagagtatagggggctttcgggatagcattgaaatgtaaataaagaaaatatctaattaaaaaagtaaaataaattgaagtacaaaaaaagaaagaaaggaatgaaggaaggaagaaaggaagaaaggaagaaaggaagaaggaaaaagaaagaaagaaagaaagaaagaaagaaagaaagaaagaaagaaagaaagaaagaaaagaaagagaaagagagagagaaagaaagagagagaaggtatctagaaaatttagtaacattctcaatggatgaatgaagaataatgaaaatgattaatatcacaactcaaaattcacactataaatcgacttaaaattgattctctttttacatgtcatatttggcttttaataacaatagtatttacaaaattttgattcttttaggtatttttacctaagttcttctgtagtgtgagtttagaaaattggctaattcattaatttttagtttattacacagtctttttccctcctctgaatatgcaaaaggattataaaatctacttctgacaagcaattatcttttatggaaattttggttaagacagctctgcttctatggttgctatttctcagttaatgtaaaattttagatttgaaatgattctttgcagtatatgtatccatgtatgatatttaggcctaattttgccaattaaaactataaaaattcagggctcgagtataagctgaatatttttgagcacttgctgctctttccgcggaatggagttcagttcctagagtatcctttgggcagctcacaacactctaattccagctccaggaagatctgatgtgctcttctggcttccacaggcactgcatcacatagaaacaaacatacacacaatcttaaaatagatctttacaatatcagtttagaattcacaaagatttcacccattcacacgcataggcctactctagtttgacttatgcacttaaagaagacaatattaaaacccttggacaccaagtgtgcaggttcacaggaaagtctgtatgaagacatgacaggaaggtaactacatgtaagccaaaaagatagcactctgtgacaaagaagtttactgaaactttcatacaccagaagtatcataaataaaatgtagcttaagctttctagcatgtgctgatatgcccttacagaataacaaaataataatcatatctgtctgtctatctatctatctatctatctatctatctatgtctatcaaactttacttagaactcttaaaaaggagtcatagcagagatatctttcatatttttctctttgagatatcaattctcaatacctatatgttataactttagtgaacctaaagtacttgactttatcgtttgtcaattaatttccagaatagaacagcatgatgtctcttcaaggtaattcaagttatttttcctatgaaaaaatagctcgtttacatatacatatagatataatttaattgaataaaactctcttacccatgattagttaagatatgcaaacatatatttattgtattttgtaacatctacaaaagattgtaaatgtttctcctgtctgtatctataatccaagatcaatccattcccattaccatatataattcattgtttttccccatcaacctttttcattttcaaaataactggaggccaaaaaggggtctgcctcagaagctctgtggctcccgcctgtcccagaaactgttagcttctatagtccacactctcacctgagcagactagtcttggtggaatctgggaaccaagatgtctcctgcagatgctccagcaactccacataaatccagagacactgaaaattatagaggagaaagtagggaaaatcctcaaagatatgggcacaggggaaaaattcctgaatagaacagcaatggcttgtcctgtaagatcgagaatcaattgacaaatgggacctcataaaattgaaaagcttctgcaaagcaaaagacaccatcaataagacaaaaaggccaccaacagattgggaaaggatctttacctatcctaaatcagataggggactagtatccaatatatataaagaactcaagaaggtggactccagaaaatcaaataaccccattaaaaatggggctcagagctgaacaaagaattctcacctgaggaataccgaatggctgagaagcacctgaaaaaatgttcaatatccttaatcatcagggaaatgcaaatcaaaacaaccctgagatttcacctcacaccagtcataatggctaagataaaaaattcaggtgacagcagatgctggcaaggatgtggaggaagaggaacactcctgcattgttggtgggattacaagcttgtacaaccactctggaaatcagtctggtggttcctcagaaaattggacatagtactaccagaggatcccgcaatacatctcctgggcatatatccagaagatgttccaaccagtaagaaggacacatgctctactatgttcatagcagccttatttataatagccagatgctggaaagaacccagatgcccctcaacagaggaatggatacagaaaatgtggtacatttacacaatgaagtactactcagctattaaaaaagaatgaatttatgaaattcctaggcaaatggttggatcaggaggatatcattctgagtgaggtaacccaatcacaaaagaattcacacactatgtactcactgataagtggatattagcccagacacttagaatacccaagatataagatacaatttgcgaaacacatgaatctcaagaagaacgaagaccaaagtgtcaaaactttgccccttcttagaattgggaacaaaactcccatgggaggagttacagagacaaagtttggagctgagacaaaggatgggccatctagagactgccatatccgggaatccatcccataatcagcgtccaaatgcttaaaccattgcatacactagcaagatttagctgaaaggaccctgatatagctgtctcctgtgaggctatgacagggcctagcaaacacagaagtagatgctcacagtcagctattggatggatcacaaggcccccaatgaaggaactagagaaagtatacaaggagctgaaggggtctgcaaccctataggtggaacaacaatatgagctacccagtactccccagagcttgtgtctctagctgcatatgtatcagaagatggcctagtaggccatcactggaaagagaggcccattggacttgcaaactttatatgccccagtacaggggaacaccagggccaaaaagtgggagtgggtgggtggggatgggggttggggagtgggggtgggacttttgggatagcattggaaatgtaaatgaaataaatacttaataaaaaaaaagagggaaaaaaacaaacaaacaaaaaaaaactagaggtatatttgtttaagctataagaagtgcccaggcgaaaaaacaaatcctgaactcgttatttctacttttatgatgctacagcttctcccctgtactcctgcctatccttgcttctgaaaacttagcttaaaggccattctcacttatacttttagctgattttacaccattcatctagccacaggtccaaaaatggtgattacttaggtcctcaaatagctattcagtttctacctgatgttattaggttgatttctttcaagagcattgacatgaagggatggtgtttgatggctttaggcatgaaacacatataatctgctatattttggagtgacagcaagaacttatcctgcctgttattagaaaattttaaaaaatgctgattatcttgctactcagaactagaaaacaaaacagaatatcaataatgctaaagtaaaattaatttgttttcatgctgaacacccagttagcttaaaaaaaatgtgttcctatctatgcattacttcctaaggtaacttttggtgaattatctattttgtacaatagcatggtttagtgttaggctttctgtgggaaactcatttttctgaaatatgtttataatatatttgagaaagtttaatgaaaattatgaactctcttaaatagcaataatgacctaatgttaaaaaacagaataagaacttcttcaaaaatattctcaagataaaaggtgctttcaatgacttaaaagtcatgaaaaatcctctacaccttccctgcaaataaatattttctttaaattaacaatcactattaaacaggaaggatgcttcattgttagtttgaaaaatatgtattttcccttcatctgcaatagcattaactaaattttaatcctaacatatacccatccagaaaaaaagactttttttccagcaattaaattctatatatcatgtcatcacttccatatatgtattccagattttccattcagattaccatactaaacattttaaaaatccctgtttaaatcaatgttttttaaatgtatagaactcttgggtatgtaccttgtgaattaaatcttctgtgaaactcactttgtctggtttttggacctttttttcgccactggattgcttccccagccttaatatgggggagaaggagatgcctagtctcattgcagcatgattccatgcttggttaatataaatggaaggcctaatttttctgaagggaaatggaaggggagtgaatgagaaagtgaggggaggttggggcaggtactgggagggctagaggaaaggaaagaagcatttaggatatattacatgaaagaagaatagatagatagatagatagatagatagatagatagatagatagatagatagataggtagatagatagatagatagacagattttttaaagaaagaaaattaacatttgataatgaaatatgcagtagcactcatttttctggactgaaaaatataacattaaaaagtcagaactttttgtgcagagttaaagatttttatggttttatattattgtaaaagactctataacacaaccttccttcttggatatatgtttcaaattctatgatgaaactagatcctctaacagaattttttttgtaaggctgccatttaatataaagatagtttatgtcatcttaatgtatattaagtgaaacagtttattaaacaagtatttgaatatgaggtaagtaaaatataaaactcctaacagtcctatggatcaaaactctcagtggagaacagtttctaaaattctgtttaagtcatcttgaaaaattatatttaaaaatagaaggaagcaaagtcaattctgtcttaacagtcattgtatatgatagtcttcttaatgcaaaatttcaaactacttgctataaaaatttttatataataaaatgctagaataatcacattaatgcacatttgcctctatattctaatgaatttttaaaagtgttttcttatacagaccttacctagacaagggatatgcttagtacatgtcaagtcaaataatacctttaggttttgttgtattaaatatctgccaaatgagatttgaaaggaacatctaccctttgagcctaacttgcccatgcttataaggatgtagaaaaagttaaaagacttgagatgttttatttcttatagaataatttacattttgttcctataaatggcacttaatatatgtaaagctagttttcataatctctttttaagcttcttatttaccagacagatcttcaaagctctcactttcttttttatctcaacagcagatagagtttgcatatatgaacaaggttggggtctactttagctgtttgaataactccaagaaatagaacagaaagaactagagagatagctcagaggttaagagcacttgttactcttcagaggatctgagtacagtttacctaaaggtagcctttcactcttttgcacctctttgggaaactgcacatacacacatacagatggaaagacacgtgcataatttaaacaatataaatatatggaaatagctgagactatagttctgatataaagccccaccctagcatatgtgaggctctcagttcaatctctagtactataagaagaacagatatagatctactataattaatccatatgttacaactttttttaaagatttatttattgtaagtacactgtagctgtcctcagacactcaagaagagggagtcagatctcgttacagatggttatgagccaccatgtggttgctgggatttgaactcctgaccttcggaagagcagttgggtgctcttacccactgagccatctcaccagcccgttacaacagtttttgaagtatagttatcacagtggtaacattgaatattcccattactaatataaaccattagttttttaaaagaaaattaatcaaagcatggtaacaaacacctgcaatctcttgcaaagttgaaacaagagaatcctgagtttcaggagagagtgagttacatagtgaaaccttgtttccacataatttaacaacaacaataacaataatattaaaataaatataataattttaaaatcaaatctattattgtcactacaaaacatagaaggtttatgctaagatcctaccaactttgtacccaattaatattttttttttgcctaaagttcttggtaatgttactgaatagcatttgaaagtaatctaaaagattaaaatttctgggataagttgtataactgaacttctatgattattatttcaaaagcaatagaaacaaatattgctatgcagaaaaggtagcagtagaattccaataagagataaagactataaatgttgagtatattaatgtttgttttgatccttcaaggcgttctctaaatattaccaagttcttattatcaacaaattgtactgtagatgaagcctctttaaaatggatactcatcaccctggaaaacttatattggaattcttgatagaaaaacaaatagaaatttacttataagtttctgtattcattcacttatagagcatactaatttgaaaagttttaacaaaaagaaagcaaagcaaattatttcctctaacaacagaaaaatgtgtttttatgtgtgtgttttctaggaaaaaaatgctttagggggagttttaaatatatttgtaagaaaacttgattactttaaatgtaaatgaagccttaaaattctttatcttttcatttatatgacaccatttgaataagaaaaacaaatttaaaactcttttttcagcttatcaaaagtatttaaaatattcaaatggccatttaaaagtcattatacactaaatcatttattatataataatttcttctcagaagcttcaaacctctaggtatttccaccacattaaacagcaagaaaaattccaagctttaatcttgtagagtaatatatttttgtatataaaaactctcataactgcctaaatttataaaattttctttagtataacaagatgtataaaattctcaatataccaagatataattttacaacttccttgaatataataaacttcattgtctaaaaggcagcactaacttaatactttaaaatctcttcaaagcaaaatatgtatattctagatttaaaatgtaaaccattcttccaatttttaaaaattataatcacaaaagttttttttttaagactttttggagttcctttgttttttcttagcttagctggataataccagctattagttaataccctcatcaatgtaaaatcataaaaatgggttaagcacaattaagagtatctattcacataaacaaatcacaatggtcacttagatgtagattgtagaacagaaaacgtgtatgtatgttaatcagctttgtggtactggcaggaatatacgatacttggtcagtactattaactacattctcatttcatgcaaacatcactactatcctatatctaaaattttacctttcaatgaaatgaaaccatgtaatcattaaatacctccttactctaccctctgccaactcatggcaacagcgatttttcattctgttttgattaatttcactcttcagcacagtaagttccagggcagtctgggatacagagcatgaccctgttgcaaattgaaaacagataacaaaactatcaaaatggaatcatatgaagctaaactcaacatagagaggagacaacatgcaggatggaagaactttgcaagctatacatatggcaagggatagaattccagattataaaagaaacctgtaaaatacaatagcttttaaaaggccccaatataaagcaagattattgccttaggttactaattctcaatagaagatatacatactcaacagaatatgaaaaagaaagctaatcatcttcacttgtgaccaatgaaatgaagacaaaaattgcaatgaagtgtcactttaccctattaagaatggctattattaaattcctaaaatgaacaaagtttgggaaagaacatagactaaatagggcccttgaacactgttagtgggaaggtaattgagtgtacctattgtagaactcagcatggtttgccttttaaagatagaagttttaaagatagttcaaaaactactatttctatgtacatagcgaaaggaaataaattcagtgtgtaaagataccttcctccttatattccttgcatcaatacttttacaataccaaggtaatggaaaataacaaaacatctatcaagtgatcaatgaataaagaaaacatggaacatatatacaatagagtacatccactcaaaaaatagtgaaatcctgataattatgccaatacacattggacctgaaatcttttgtttgtttgtttttgttttgttttgttttgttttttccagacagggtttctttgtgtagctctggctgtcctggaactcactctgtagactaggctggccttgagctcagaaatctacatgcttctgtctctcaagtgctggaattaaaggtgtggaccaccactgcccacctgggacctgaaatcataatgtgcttgaaaaaagctaggtgtgcatgtgcacgtatgcacacatgtacacacacacacacacacacacacacatcacattatctcattctcataggatctaaaaaagttagcctcttagaagttgaaaacagaatggtagtttctagacacaacaaagagtagggggaagagagttgattaaatgatattgagttatacttggctctgagcaagcagttctggtgttccattgcctaagatgactatagatgaaaatgtgctgtaacttttgaaaggataggcatattaatattcacatttttcaccataaagaaataagtgttttgaggatataccatgcttaagttatttgaaaattatacaatatacacttgcactgaaatatgatatgttattccattaatataaactttttgtgcttcatatatgtttatattttaaatttaaaattaaaagtaaatgaaaatacacctactctaaatgtaatttcaggacattttcttctgaaaatggcaatctttagaaaatgactaccatatatcagaaacattaaaatgttatgaattaatccactagagaaattactaagaaattctctaaatatatcttaaccactaagaacatgtattttactggtctcattttaatgtacagtttcaaatatattttacttaattttgttttgatgttgctagagaataaagtattcaagctaattaatatactcattactttagaatttgctgtactttttccagaaaaaaatcatgtgtttatttgtgtctgggatttgatgatgaagtagagggctatagcaattttgaattgttttggttttggtagttgagtataagtaatataagataggctatttctaacaatataaactctatagctctgtggttttatttatattctcttgtgtaatggcttaattcaattatgaaattaaatgcttagcttgaaaggcagtgttttttatctgactgaatcatttttcactagcattttaccaatctttctttaaaatgctacaattgtatattttctatgactaagttcctttgcaaagtgtgttgatctaaaaactctggtatattaattcagctttgaagtcttttttttctttctattgtaatttaggaagtttccatttgacagtcctgccttggccatggaaggtccactgagaaatccataacaagtcatcccaatttctactgattttcagtattccatgtgcgttatttttttagagtttctacttatctaatttaaattactcaccttgtcttaaatgttatccacttttcccattagtaccttagtacttttatattaatcacagttatgtctttctctcttctctctctctctctctctctctctctctatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagagggtgtgacattgcatattcctagagattgtttttctccttctaccatgcaggatttgagaatgaaacactgatcaacaggcttaaggacaatagcttttatctactgagccatcttgcctgctcaaatacgatattttaaatatattctcttacagttccaacatctgagtctctgtatttggttccaaaacaagtatactcctctctgttctattatcagttttgtgtaccttgactcatttttgaaaattaggcattttagattacagtcatactgtgaggatttatgttagtatagccaggaatagtgctgagttgaagtatttctgtagctatggttttaattttatgtattctccttcttttcattcctcttagtttcctcattctttcccaagagctcctcagatgactctccatctttggttcttttcagctgctatctactcaaatttactgtttacaaaaaaaagctctctatatcttaagtttaattcttggtttttaggttaactatgaccctaggctgtgaaattcacatgtgtttcttagccattttatttttactcttggatgacacagtatggatagatggaactagaattcagaaaaatgtcttcttagttgcatgaggctctgaaaaaattcgttcgatctttcccagtatttgaacattgtcctgcagaacataaatgctggcatgaatttcactgtatttgtattctaccagctcaagtggcagaaccaacagatttattttggcttgccattatgaaaaagggtgaggctgaactactggaaaggacattcagggaaatgaaacacctagaaatttctggctcattgatagtctgtaaatattgtctagcaagctatcaaaattatttgttaagtagtcataaaaatgtctgacttcaggaacctcaggaatctaactcagaatttgcacttctcatatgccatatgtcagaatgaacaactttttcacctcacttctctgacaaaccaaagaacagacaatctttgtcagtataggttcgattgtgaggctgacttggaggctgtttagatgatggagcatcttcttccttttatggagaatatatattatgatttctcttccctctacttcccagctcctcccatctctctttacttctgagtccaacccctttctgtttctcattagaaaacagacatctaaggaataataaaaataatataataattttattaaaatgagataaaataattcagaatacgataaataaggaaaagggaaagagtccaagaaagtgcacacacacacacacacacatacacacacatacacacacaaactgatatacatacaaagattcattagttcacactttcaggaatctcagaaaagcacaaaacaagaagccatgatatagatgcaaaatctatagaataaataaataattaaattaaagcaatttaaaaaaaaagacaatttttaaaaagccctgacacagtagaacatgaacctccaaagattcccttgagctcattttctgttggccatctacttctgggcatggtactgacccttaagagtgggttgtttacctagtcagttgctctcagagaaaacaaaattttcattaccaagtggttataaattagaaatagtttctgtgttagggatgggggttatgtctacttctcctttcagctctagggccccatctggtgcagacacttgcaggctctaagctgcttcggtctatgagttcatatgtttcctgctatgtttagaaggctttgttttctcagtgtcctccatttcctttggctttatgcctcctcttccttaaatgaaatcagatattgattggttactcacacaagcttgtaccaccactgccctactgtaacattcaagaagtgcaccacagtaggtagaatgttatataactggagatatatacatacatacaaagattcattagttcacactctcaggattcccagaaaagaacaaaaccagaagcaatgatatagatgccaaacctgtagggtaaataaataattaaattaaagcaaaaattaaaaaataaatagacgatttttaaaaagccctgacatgataggacattatattccaatacaatgaacactatccaggaatggaaaggctgtaggtaggcaccatctctatttctccatgttcaatgatttatatatgtgctgtcttcagcattaaggccttgctatcagtttgtggaaagcaacctatagcccttgctgcagcctgtattgtttagggcttccaatacaatatctgtagcccataactggtttagaagtaacatattctggctcctaaagtttcatttggtgatgagacatatctagctgtggctgtttccactgcgattgggtgattttattttgatcaccttcatatatgtagacgatgtaggaagtttccactgtatgaggcttccataaaatccctcaaattgactgacactctgcatattcactccctatctgcctcttctctctcatctcctatttgatgatgtttgagctcttaagttgtcatttaaactactactcagtaaagtgaattacacgaaaattaagaaaaaggatcaaacaaaaattataatgtattaatttgtccatttaactcagtgtaagaggaacaatgctaattagacaagtgacctcttgtgttgctaaacacatatagtggctgaagagaaattcctctatttaagagcatgtgctacacttatagaggacctaagatgtatatatgtatatgcaggcaaaacacccacatacaaaaaataagaaatattaaaaaacaaagcaaaaacatgtcaactagtcttgtaaacaattattcgtcagccaatgtcagatctaatacctctttttctagttgtaaatgtagccaaatctcttttaatccagaaagaaagcttaccagccttcaaatacctctttggggagattgtgttagcctggctcctggctatgtccttcagctgcccacataagggacggatgtgatttcaggtgtcacatgtttggtctcccattccacttagaattctaagttttaccactccatctgtgtaagccccctggaacttttagcttcagtcagcaatcgctttgtccctctaatacactcctgatgtataatgctgtgccttgggctctcttcaaaagttgcctaagaaatcaatgatgtgaatccaagcttacaataaaaatgattgctgagagccaaccaggtgtagacttatgggccctagagtacacatattcataaattaactcttcactagccttgactgttgttttcaatggtgtgttttttcctacctaagcaatgatttttacagctaaaacatcaatagaaacaatgcttcattacatatattgaagagtctggataggcttgaaaatctacacagaggtcatctcctgaggcagtgaaactgaaaaaaaaaaactcttaatggagtttttcagaccacctgttacacttggataattcagaaacagcttttcccattaattcattccaggcaggaatctaatcctaaatgaggcatgttataaagcatttggattagtaacaaagccattctaaccatatgcttgaatttttgtaatattttcagacaatgttatagtatcattaatgttttattttttttcccaacactacctttttaacatgcagaggctctttttttggagagtaaggtagaaaactaaataaaagatagatagtacatgcccactgccattcttgctatttgctcctaaaatctggaataaagaggtggctggccatctcttttgtgactctgcaaatgtcagtctggtcctcaccattgaatcctacctgtgtgcatatccattcatttgatgcttcctatggcatgagattatgttgatatcagcagtacaatgagtcatttctacatccttcacagcttggtatggagcctgacacataattggtatttgatggtgttattcagacagtaattgaaaaattcaatgacccatatatatgtcacatttcagatttccttaaggaaatacactttggatgactaaagcatatgggacagatagaagtatcttgagagtattgtaattataggagtggacactatgaacaaggcaatgcctccctgccttctatctaggacctttctgtggtagtaatgaaaaccagaatcctctctgtttttatttgcacagttcatttatactttttttttaaaaaccatataattggagaaattttcctttaatatggtcttcaaggtatcttgtaaatagaaacacaaagcagactcaaaaacactgctgagagtcctactgggtccagtctggagaatatatggatggtgtttccatccctgccatcaaggtttatatctactgagatgaacaaccaatatttggctaaagtgaactatggatgtaaggtatccattagccagatacatagataaattagatagatagatggatggatagatagacagatagatagatagatagatagatagatagatagatagatagatagatagatagaatgaagtaagatactattttaagaaaaagatgccagaagatatctcttcaacttttaatctcattttctatgtatggatattttggttgcactatatttctggctgcatatatatctgcatatgatatgtatttcagccttcaaaggttagagaaggttttgggttcctctagagctaggaaaggggacagacacttgtaagtgaccatatggtgctaggcatcaaacctgggtcctctgcaagaatagccaatattcttattactactaaggaaacattccagccccagcggatacattctaagacttcttagatactccaaaccacactgctgagttctatgataaattctaatttataaatcatgcacacacaacaacaataataactaatagtaaaataccagaactgacatgggaatgcagctgagtgctagagtgcttgcctatcgaatatgtacatccactgagtttgatcctcaaacagctataattgtaatcatcctcatcgttgtcattgatactatcattatcataatcatcactatcatcatcattgaactagtgcagttttcctggtgttttggatgctggcatcactattttgggaactgaggctctactggacacgagctccaagaattacaatggacctgatggtctagaacttacctaaggcagaacacatcagatggatatgttagacaaaggaattattgcacataaaagatagatgaacgacttgagtcctagttatagaaagcttttagcactgttcataataatgtgcaatgtgacacttataagttacttatttctgggaaacagtgattaaatattttggactctagccaatatacctggcctgtatacatgagttctggggacctgaaatctagtcctaatgcttaaatggtaaacactcctcaggcatccatctttgcaaatcgatcctttatatttctttgtaaattaattatattcctatcaagaaatactcttttctaaactgatcttatttaatgaattggaacagttctacccatctcttgagcacaaaggaagatcagtgttgtagaactgtctggtggttagcaccttcgaaagtgattcaaccaatcagaaagtgtttggcagatagtaaaagggctttttaagacccagggaggttgggctggtgagatggctcagtgggttagagcacccgactgctcttccgaaggtccagagttcaaatcccagcaaccacatggtggctcacaaccatccgtaacaagatctgactccctcttctggtatccctgaagacagctacaatgtacttacatataataaataaaaaaaagacccagggaggcttggtcttagcaaaaagtacagtgatttcaaatgcttactctactattatgcccttggctttagtgcaaaataagtgagcaatgtgggaaaatccttttgtaaacagaaaattggggaaaacaagacaagaatttacagcgtactgtagtcattaaatgaaatgtttgggactatatctggctacaaccagaattagggttaatggcccatgggaaactgacaatgctaagtcctttgactgtcatcagtggaaactaagtgaatgtcatttatggtacttctgtagcttttataatctctcttcttgggagtggagtgctttagatattttgtatgtttctgtaaactttcagcttacacactttactgttgttatcactgctgattaaaatttccttcattccaccttttcaaaacttaccttctccacttgcatttgtttcgtactttaagttggtgatattgccacttttctgacccaactattaaaaaaaaagaagtacaagatggatgtttcccaaattaatatcaccattcaggagagtgtccctgttggatgaaactcttactccagaccaccagtggttgcctttggcaaatgcctggcctaaatccaatttccatggcagtagtgaggattaaaaacattcatttatttattcaatgtataatagtaaagcttctgttttgtgccataaagagtaatatgaattatgaatcttgactttttaataagaggagatcagctatatcaataatataataaactcaaataaaataagtgtacatataaaaagtcacagatatggtaggaaactctcagaatgaggctgttgtcatgacaatcttgattaagctttcttagagaaaacttatactccagcaggtccctgtttgaactatatgagtaattttggtaaaaaataattcaaatacatgtgatggggaatttaaatgagagaaagtagaaaatgaaaatatacataatatttgtattaacctgatagtaaatagcattcaccatatgaataatagataaatgtcattaagaatcagtataaatgtgaccattgtctactttataaatggttatttattttaatgaaaagaagtgtggcagttctataattttattgccttgcaattccaacgttgtgggaaacaagttgaaataccattccacctttttgttgttgttggtttttgttttgttttgttttgttttttgttttttttttttgtttgtttgtttgtttggtattttgagacagggtttctctgtgtaaccctggctgtcctggaactcactttgtagaccaggctggcctagaactcagaaattcacctgcctctgcctcccgagtgctgggattaaaagcgtgcgccaccatacctggcaccttgcttatttcttatacaaccatttaatatgctcaagaacagccacagatcattttgtatactttcaaagatttaattttatttctgagggtaatactttatctcattgagcaattaagggatgatactaaatttgaaagaaatatttcctgcaataaatcttgtcccatgattaaatgttcattttataagtagtatctgtgcattcttagcactaatcaagatgggaaataaaccagattatagttattcaatatggtaatggtttttagaattctgttctctagatacaaactctcttcctaaaattgttgatatgaagaaattaaatgtctgtatataattttctgaatatatatacatatatatttccattttgatgttattttttttaaattactagccttggggtggaatctttgaatccttggtgttgaatttctccccttgcattttggtcctttatgataattcctgcatttgaacatttttggaacaactatattaggaagcagaatctcaaaacctggctttgcagaatatagggttcaagatatcgccactattttgaattgtttctgcaaactcttgttttggatatatgttcatgtgaaggtgaaaaggcaggaaacaaatgcaaaagcatgaaattaaaggcttgaaagtattaatgtctgtaactttttttctagaataatagtgaatcttaaacattaatttgcaatggtattattatataacatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttttattaggtatttagctcatttacatttccaatgctataccaaaagtcccccatacccacccacccccactcccctacccacccactccccctttttggccctggcgttcccctgtactggggcatataaagtttgcaagtccaatgggcctctctttccactgatggccgactaggccatcttttgatacatatgcagctagagacaagagctccggggtactgcttagttcatattgttgttccacctatagggttgcagttccctttagttccttgggtgctttctctagttcgtccattgggggacctgtggtccattcagtagctgactgtgagcatccacttatgtgtttgctaggccctgggatagtctcacaagagacagctatatctgggtcctttcagcatatatttctatgatgacactccccttaaagagggatataactgaaaatactctatgaaataaagtgaataagatgcagaataatttataatgggattccgttgtcatcctctaacttgtatgaggctggataagtatctgtattatcacttttgctataataaattatagtaaatttaaatggcttaaagcaataaaacatattacccatcattctgaatgtcagaagacaaacatagatcttgggtgatcaaaatggtgacagggatagctttcttctagaggttacagtggggcaaaccatctctttgcacatctcaccctctagaaaccaaaagcattcctttgttcatggctccatctttcatcattgaagcatcaatgcaaattcaatccatatatttgactaactggttttgttagagtttcttctcaccagtgtaatttctgaatctaatgtctccttttcatttattgaaagaatggtggcacatacaatcaaataaaaataattgatgatacttcccaaaataatagtgagtttaacttatcaaaataatagttcattatatagtacaatgctgttctcaaattcacaattctactgccttatccttctgatttttggtattacaagtgtgaactaacttatcattcttttctattatgagaaagtgagtaacttctatttattaacaagaattaactaataaaaaaataagaaaactctttaggtagataacaaaacaaatgactaaatgaatgaagaattattgatttttattcttaatcaggaacctttctgttcatcaccattttatctcatcagactggaataaattgaaactatgctatcacacaatattaaaaattatttaaaatagcttaagttgtacaaacaagtatatatgtaatttagtgctatcacacaggaatacaaagttttcgtatttgtcctatagtaatatttatgcacatatgtcaagatatcattattttttcattattgcttgcaatatagaaaaaggtgcagtgaaaaaaagcagacacaagccaccagaaggaaagcaaatcaataaaacatggcaaaatgtgtaatgttatagtatactgaattaactgaattaaatttatacatttattatatggagaaattttccaaaaattaagaggtatatgatccaatgataaatatagccacaaaaattaaaacattataactaggaactccattactataatactcatatatgcaaaagttaagaggtgtatgtataaagcaactatttaattgcgcttattttagtagagaggcccaataggtcagcagtggaaatactgatttcaaattatcttattttgtgaatatctgtaattgttgtagtttaaaataagatggtcagctaacggaagaatattaggcttcttgttagcaaggttagatgctagaaaatagcagagaatcctgaaaacattgattaaaaaatatgtcatcctcaaattcagtgtcctgataaattatttctaaagaaagagaataaattgtcttgaattgaaagatgaaggcaaattttgccaaatggatatattagatagattggacgggtagatagatgatatattacatagatagattagatagattagacagatagatgatagataatagatagattagaaaaatagatgattgatagatggatgacaggtagataaatgatagattagataggtagattgatgatagattgacagattagatagattagattagatagattagagaggtaaatgaatagatgtgaaataaatgataaattatagacagataatagcaaatgaacttaatcagcaatcaataatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctattttgaacctattttaataaaatacggatgaaacataaaatacgtgatgatattcatgacagtatacaataaatggctgtttttaatattgtaaaataacacagacatattctttcttcttctaaaaagaacagtgggagaactatacagattgactctttgtatgtatatattcaagatacacttacataaaaaggttttcttggaaaaaaagtatttattctgagagtgaagcatttcaaatgaagttattagaagaaacatgggcagagcataaggaagggttgtatttttatacaaatgtatatttaaatagagtggaatgactcttaattctgacatgagaccttttaaattacttaaatatatcagtttttttctaataataatctaatctaaaatgcaacaatttcatgtttaattaatgactactattttctcttggccctttaaacacattttaatgatcaagaaaaacgagatatttactaaatagttaatcttatagatagtcagcacagatgaagattgtataaggaaatagagtaaaagaaattcatggagtgatcaagttaaaaattcacactccaaggatcaccagttttgtacacaggcaaagatactttctaatatttaaataatatgttttaggtaattttctggggaaataatggtttaatttaacaatttattatgttgtgatacaagtagcagataaattcagcattctaacaaactttactgactcataaacattagttattgttctaattcaattttttgttttgcctttctgtttttccagagggccagatttgattcctagtgcccaaatggcagttcacagccttatatagctctagttacaggtgattaaatgtcctttccaagcttctgcaagtatcaggcatgcatatggtgcatagatatgcaagcaggcaaaacgcccatacatataaaaggaaaacttaaaaataaaataaaagtaaagcaaagtaccctgccctagaaatataatgaatttcataggcctggaaatttgactctcagatgattctagagcctatcaagattagttatagagatctttcttcataatgtgttttaaggtctaacactgatgtgacttaggaatctagcataaatctagcatggttctgacaaatttttgactagaaaaataatttaacaacattgcttttcttttatatgcagaaaaatgctttctatgtgcctcttaatgtggtttcctttcccatttgtgagatccaagaaaacttcccaaaggctagaataatgcatgaaatcttcagaatatattaacagcaatgaacattttcatgtttagtacaaggagtgccttccactctgagtatgttcatatccactgcaaaaataaatttactatgctattttaaaaagtaactaattttcatcatttttgtctcaacactacactgctagagcagtgagatgatctgattaaaattttcttataattactgtttatgataaaataaaattcaaaaataatatcagagtatcaatatgagtgaaaattttgtcatctccttacaactacttatggtaagcataaataatctattaatgcaacgtaaaataaagcatatagtaatttcactactaatttccatattatcaatgtattcacaggaaaatatcaagctactcatctgagatatgtgagcttatttatccaagtttgaatataacctgttatatgaaaatatgattcaggtttaataagaatatagtaatatcactatcaaatagcatgacaaaatgactattattgatcccattagacagctatactattaagggaagggaaattatgaccttaaaatatagaattgatatacataaccatgagatttgtaatcaaatctattttggttgtcaaaaactagatgtgtacttagttccataaacaaaggtctgtcccatccagcaggacctagttattcgtgggtgcgagggggaccacaaaccttggagaaaatgggagggagagaaaggagaagtggagaccaagaaggggttcctatcaaggtctcagtttattaggctgaaacgccaagttttaagcatacagtgagggggatagggaggggttgagggggaattaacaaagaacaaataagtgggcatctggggacatgaaggccgaattcaggctccaggcggtgggcactctgcgtcttatctctggaatgtagatcctccttaacagccttgggtgtcaggctggacttctcatgtccttagaagtcttgggagtcaggaagatataaggaagaagggactataattcagctttttatagcctcaggtgccaggaagggaatagggaggagggggtgatgaccagctccatagcacaaggctgtttggcttgttagggtgggaagctgtgaaaggctttctttcccacagtatggtctccaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgataagaaccactaacctcttacttggattattttgctgtgtctgtagtgctgaaaactggagaaaatgaataaagaaaagactgtagtttagtcctatttcatcacaagtttctattttaaatcattgactcaatacagttgctcttgggtgtgcttttcacattgtacggctaattgaagcatgtaactcttccaaaattagaatttcacgtcatattttaaaattagaatcttcagattataaggaatcataatgttcttagcctagaatgcatcacaataatattacttcctataagttaatgttttcagctaataatatagaaagatctgagaagacatattaaggcaaacagatcagttttttaattaggtattttcttcatttacatttccagtgctatctcaaaagtctcccataccctcccccaccccactcccttacccacccactcccacttcttggccctggagttcccctgtactgaggcatataaagtttgcaagaccaattggcctccctttccacggatggctgactaggtcatcttctgatacatatgcagctagagacatgagctccagagggtactggttagttcatatagttgttccacctataggtttgtagaccccttcagctccttgggtactttctcttgcttctccattgggggccctgtgatccatccaatagctgactgtgagcatccacttctgtgtttgccatgccccagtatagactcacaagagacagctatatcagggtcctttcagcaaaatcttgctagtgtatgcaatggtgtcagcatttggaggctgattatgggatcgatccctgggtatggcagtttgtagatggtccatccttttgtctcagccccaaactttgtctctgtaactccttccatgggtgttttgttcccaattctaagaaggggaaaagtgtccacactgtggtcttcgttcttgagtttcatgtgttttgctaattgtatcttgtatcttgggtattctaagtttctgggctaatatccacttaacagagcaattttatttccagatagattgcttttttccttgtctctctctctctctctctctctctctctctctctctctctctatctctctctctctctctctctctctctccccgtgtgtgtgtgtgtgtgtgtgtgtgtgtgtgtgtgtgtgtgcatgcacatgcatgcatgtgtgtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgatgcacaacactatccattgtatttcgatagttgtttgtggcttgtagcattctttttcctggaggaaggaaaaggaagtgaaatgatggaaagaatggtcatttcagtgcagatgatattagaattgatgtcacttttcactcctatgtcaccatcttctgtaattcttgtcccagaagtgatagctcctggaggtcttacagttaatgatccctcttgattatcagcttatcaaacaaataattattgaataattaaaaggaatgtactgttcttgactgtaaaatttggttaggtcttttaagttccatgctaacagccctttatcttgtaagtattcaaaaaggcttaatgctaattagtatctttgagtttcaatcatactattagagggttaagacttgctataatgaattctcacgttggtttttgttttaaatgccccccaaaaataaaaattaagctttataatcatttacctcaagtgtatatatagctggtatttgtaaatcttttaggattaaaggtattatttattgaatattaaactcagtagcattttacatagaccaagtgagaaaaacctgcattttcttgttaacataggccatttttattctttttagctaatgtataaggaataattttaaccattattattgtttttttcattttcaaatgaaaaatataagcaaataattttcattaaaacttttttgaataaaataagttggcttgttcacataataaaacatgtttttttaaatactcagtatttacaggcatgctataaattacttattctaccctttttcagcctttatgccaagtgaatgtcctattcagaaaaggattttgtagcaaggcatagtgcatagaggcatatgtatccaagcctcataaaatgagttcaaactgaatggtagaccagaacttttcctctgactacaggatcccagacacatgcatgtacaaaaaaagaaaatgatgtattttaaaggtgtctttactttttatatattcccaaatcagaaaaaaaaacataaataattaggcttgtcatagtggcatgcatttataatctcagctctgggctgatatgtaataaagaattgtgagacagcctggtttccagagtgagaccctgtaggggagaggaattttgcttatcttctgtctgtctgtctgtctgtctgtctgtctgtctgtctgtctttaaaaaaataaaaattaagagagcaaaatgaaaaatatttctctttttaaatcctaagtatatgagtattcttttgcatacatgtctcagtgttaatggaggccataagagagcactaaatcccaggaactggagttagagatggatataactcactgtgtaggtgatggaaattgaacctgtaacctcttgaacagcagtcagtgctcttaaccactgagacatctctccagccccatgaagactaattcaatgtaatatgttgatatatagatacagctatgttcatctaagtgctctattggtctttaaatttttaacaaaatataatacattccaaatatacataccagtaaatgttttctttttatttatttacattcatgtaatagaaaactaggtatagcatctacttaatatgaaatataaaaaattcttaatatgaaaacatcctagactgggtaatttacaaacaacagaaattcctgtttcattgttttaactccaagataaaggcacttgtagattaggttttaactggaaggtagatttttgctttggaagtggaacatgttacactgccctcagatagcagaggtccacacatatcaccttcttttaggcttttataaaaacactactcccagttacaatggcttttcccttatactctaatcctaagctcccagtcttaaaaccaacaacagctaaattaggatttgaatttggtatagatccaaatgttcagaatgcttcaagtatagacttgaagttagggagaatctgaaccagaaaataagttctgtaactgacttgtcaaaatgcatttttagtgttgaggaaagactgattaaagaagccatatctttcctaaactaaaaaataatgtatatgaaaacagattatttttataaaattccttacagttgtttgtctctcaaaaacttactgtcccaaatagaaagagacttctgtttagtcaaaagagatagttaggaaaaataacctaaagcaaattaattttttttcaattttttattagatattttcttcatttacatttcaaatgctatcccgaaagtcccctataccctcccactgccctgctcccctatccacccactcccacttcttggccctggcattcccctgtactggggcatataaagtttgcaatcttttcccaatgatggccgactaggccatcttctgatacatatgcagctagagtcaagagctccagggtactgattagttcatattgttgttccacctataggattgcagaccctttcagctccttgggtactttctctagctcctccattgggggtcctgtgtcccatccaatagatgacaatgagcatccacttctgtatttgccaggcactggcatagcctcacaagagacagctatatcagggtccttttagcaaaatctttctggcatatgcaatagtgtctgcgtttggtggttgtatatgggatggatccccaggtggggcagtctccggatggtcgttctttcagtctcttctctgaactttgtctctgtaactccttccatgggtgttttgttccctattctaaggaggaatgaagtatccccgcgttgatcttccttcttgattttcttgtttttttgcaaattttatcttgggcattctaagattctgggctaatatccactaatcagtgagtgcatatctatgctctataatgacatgtatcattttgttaatgagttacaaatctttacagcttttgggacttcattnnnnnnnnnnnnnnnnnnnngggacttcattattttcccacatagagtattcctctgtaaaagtcagatatcagtagtgagagcattttatgtaggttcagagaaaattatcattttaaggatcatattaatattaattggcataaatgttacaaaaattatcacaggagatattgtctttttgctaacttcttaggttcattatcctacaaaccagggaaagatgtgtttgtgtgtatgtgtgtgtgtatgtgtgtgtgtgtgtctgtgtgtgtgtctgtatgtgtgtgtgtttatgtacatatggacatacatatgtatatatgtatgtgcatgtatataaactcttattccaaaaatacctactatggatataaatgatttggataagagaaagcacatatatttgaagggaagtcatcactttagaccattgtgcactgcccagtgcacaagattcttaatgtagggcttatcacttggggctacttaaagctgtcctagtagaattagtccaaatgacatttgtttctgtaaggactacttgccttatttacctgattcggagttgattctttgaacctgaactatgtcatctaaggacaaagtggctcccagagaactctgtgagctataatgcacatgaaattccaaaggtaactttgcaggtaacttctaacccctaacttctgtcttctggataggcttgtggcaatagtggcgaagcatagtcatccctactattgactgaaaggtgacccattgaaagacattagagtgttttttttttttttgtccctttcataaagctcaacttcacttctatctcctatgttgtaatttataaagtgaaaactggagtttctcaaaatatgcacttaaagagcactcaaaggtatcatcaccatggagacagatgcctgagatccggcttatgtcagactcttgtgaaagggccttggaatcttccttttttacaaacttacttttgccccataatgtttgagtactttggactactttataagatgaaccactgattttatgaaattttaaaattccatgacctgataatcccattggtttcttgatactgtgttccataatgtctttgtatatttggcattctcatttcttctgaaagtttaagtaccaggaactttccgaaatgaaaaccaacgaagggagatacttttacatgagtcaggtttgatagatgtttgcaattttttgtagttattcacctctttcatgataccccttctcacctgtgatacattagatgactaatactcatgacttattgacagtacatgataattttgtttaaatcactggatgtcttttatcaactggctctcaccactgtcactggtgccttgattctaacatagtgatttaccagaaagttatagattatattgtcttatggaaatcaatattttcactctatttagaagcagtttcatgcacacttcagatgaaagaaatattcattttgttgctcctctgaagttgtgaggctttccatgggtctaggttaagtttcaggaggcagcagtttatttttggattacagtgatgatttagagttcattaggattttgttgcttacaaaaataaaactacagtaaatttaagttcacagacatggctttatttcagtatgaaacatttttcagagatttgcttttcaattcatgacttaaaataatcagtgtaataggaaattgctatatgttatgaaaggctattattattacaagccatctgaaactgtgcattcattttaggctcttgaacttacaaaatgtgaatgggatttgatcctagtttctttgtttcatcacatttttggaagttgtttacaattttattctctaaggatacatagaattgatgcctttgtacttgattgtctgtgggcctgggggaataaggggagtgggagaaaacctgaatcccgcccaagttctggtgctctgggtgggcagaaatggaggacagcctcaagctttccacacagccccaagtgggagtctgactgtgggaagccatggatcccagcccacagtgggtagacaagggtcagtctgaggtctctgggtctcacggaggccagaggtaacatgttctcagtctcgggcatcccagacaccgctggctaccactgaatagctggacccatgggtgtctcacccagcctcagtaccaaagagaggagagggcagggagagatggggtgctgggtggttctcacataggtgaaggcctttcagcgggatgttagacaaggctctttagcggaaagtctatcccatcaatcaagtatggtaggccttgatgagcagagacaggctatggttttagagctttattatagaaaggcagagagaaagagagagggtaaaagaaagagaggctagccatggccaagtgaagagaagggggggaagaaagggagaaaaggagagctaaagatgagagtaagaaaggtgagagcttaagagagaggggtccaaggagttagacaaagtacccaaggaactgaaggggtttgcagcctccaaggaggaacaatatgaactaaccagtaaccccagagctccctgggactaaaccactaatcaaagaaaacacacatggagagactcatggctctagttgcatatgtagctgaggatggcctagttggttatcaatgggaggagatgcccttggtcctgtaaaggttctatgctacattataggggaaggccagggccaggaagcaggagtttgtgggttgggaagcaggggaaggggagagaggatagggattttcagaggggaaactatgaaagaggttaacacttgaaatgtaaataaagaaaatatcaaatttaagagagagagagagagagagagagagagagagagctcaagcagcccttttatactgggctgggctaccttgtagttgtagcatagctgtgggaaggagcataacatagccagctaatgttaagtaactgtgagggtggagtctagctagaatgccaggagcatgtatgcatgactaatagtcacagaataatggagttgggagctctctggtgtcaggcacctgtctctgggaacgtggctctctgttctgtcccttgtagaagtttctactgggtctccggagcaagccttgctcaaccaaaacaggctgcctttcatggtcccacacttgatagtgtttttgcagtctcggcacatcataagcttttcatagatgagtgaaataggtactatgagaatgaaaagggactctttagaaaccctacaatgacatcaccaagcaacagtccccgatctcttccaccatcccaagccaggtggccaactcctcacctttacctgaaacataaactttcagaactccccagattcttctatcttctcttccctagtctttccaaaattatatttcaaagaaacatgtccccaagtctaacagaaagagtacctttttctcagagtaacaattgtaacctatactgaatgaatttaacttcactgggatgcattattaatttaaaaggctaacaaaaaataaaagtcatgtatacggtaattgtcacaaatgttgaaatttcagatattgtggccaaatgacagccatatttttggattggacactaaagtaatcacctctatttctgcttctaattatcactggtttgattacaacttgatttgattagctttaatgtataacatattttaaagaactctccttagaagaagtaggagagtgtaccaagagattagtaaaaatctctgtttcttttatctaagttatttcctagctgtggtgtgtattataattatcaccaagaactttaactacccggttgttcaggccatactagaaatcagttaaatcacaatctcgtggaataaaaatcgggctttagtaaatacaaagctgtccagtgataaatgtgtttgagtcactaaactaaacaaagataggaaacacaatagatttctcatgatatatccagggaatcattgttataatgataagacatgtgtaggattgtagtactaaatttctgggaagtaggaagcaaaggcagcaactattgaccagagataaagctttgcaacacaggagtaaagaaatgaattaaaagcataggcttccaaagaagattccctttattgtgtgagcttcagcaaatgactttctatattttctttttctcattagtaaaatgaggaagataattatacctatctctggaggtgatggtaaggattaaatgaagtcataagcaaaagatactttagccttatattgagcatataacaaacaaactacacagacttgttttattataatgagcttagaaatatgagagttcagttatatttttgtagtgtttgtttagatttcaatataaagtgaaaacaaataaaagttacaggagttgtgattctttgtagtttttttaattttttctattttcttaatacctgtccctaccttcaacctccaagtgctttttatcttccttttttgacttttattgtcttattatactttaaaaaaataaatttttcagcactttgagaattccatacaataagttctgatcatattcatcccacttcaagtcttccctgaaccaaactcttgtctttaaccatacaactttgtttccttttttctttaaactcatgaagaccagtttgtgctgcccaaatattcttggatgtaaggccatacattatggcacatgttatttacaagagtatattttctatactcttagagaagattgactatctctctccaagaaggtaaaattgaccaatgacttctcgactaagtatgggacttgatgcctagcttccctctccattctgcaatttgctctatttatagtttgtgtgggttttatacatgttgtcacaattgctgtgaatttatatgtgcagctcttctgctttattcagaagtcactgttttcttgtagtcaatcatccactacctctggctattccactatttctgtcccctcttctgttgtcattcctgagccttataaagaggagttaagatataagcatttcatttagggctgagcattctgtgatctcttattcttggttgctctattatactcttttatctttaatttcctggtattcccaatacattggaaatgacacaataagataaataagtgaattagctctctcaccttagactttagtgtagctaaatacgctcaacaataataactattatactactgaaaagaacaattttgctggactgccacaattgctctgtctgtaatgttcttacagcacaatcaggagttactaagtctgggttcccaatgccttaatcagaatatgcctgcaatccaagcactgggaaagtagagctagaaagatccccagggctgtctacccagcagtctagctaactgataagtctcagactcagtatgagatcctgtctctgaaaataagaagaaccattaacaaatcatcacttaacaatgacttctggcctatgaacacataataattgtctaattcttagaattggctaatgtggtctctgctatattctttggctgggctggtcatgcatgtgtgtcaactgttggtcataaaggcagcagtttatataaagttggctggagaaagcaggaggtaacagtaatgcctgaatcatttgtctcgtgacccattataaagcaagttagccttgcctcatttattttatggaagcagtttctacgaatagaaacataaagctttttaaggtcaaagctcagaaatactgccatatagttctacaaagttctttttttttttttaagtacagcataaggccagccaatgtcttagtatgatgactaatattgtgaacttaacaggaactagacttatttagatttctgagttcgaggccagcctggtctacaaagtgagttccaggacagccagggctatacatagaaaccatgtcttgaaaaacaaaaacaaacaaacaaaaattaaaaacgaaaacaaaacaaaaaaagaaacaagcctgtgggcatgcctgtgaggggttatctacattaggttaattagtatggaaagacacaccttgaatgtaggcagcataattctttggtttgggatgcctgaccaaattaaaaggagcaaatgaactgagcataagcatttattgttttcagtttctggactacaaatgtaaagtaaacaaacatctgccttgagcatctgccaccatgacttttctaccctgtaactgggagccatcatacttttccaaccctttaactgtgagcaaccctgactgtcctaccctttaactgtgagccaaaataacatattcctttattattattatcattattattnnnnnnnnnnnnnnnnnnnncccacccacccactcccacttcttggcccaggaattcccctgtactgaggcaatagaggaatagaaataatttccactggcacttggaagtgaacagtattgtgacactgacttttataaactttgcagtagtaacctactcaaatggactgtgagtggaaatgaggtcataatgaagatgacactatttaaaatacaaaggcttattatatgtaagccttgacaaataaacatggatgtatggacagggacaaaatggagatcaaggatgttgcagtctaaataactatggctattgagctacagtaaattttaattagaaaggaaaatagtagcaaagatgaccaagcatcacatgtgcaatctcttacagaaaacagtcaattgcacttatttgctgatgttgctttatccctataatgattttctcccaaggacaaaacatatttcaatttttattaatggtttagatgaaggtttagacatgttacttattagcaagacccataatcccttggcataccagcaaaaatataaataatgtatgttgcttattgttgaaactactgtgccttattttcaactccaaagcaagtcatcactttcaagaccaaaatatttgatataaagtctatgaaatagcttaatacacgagtagagaaatctgagaaatcttagaaaaatgtgtaagaaacaatagtacttacctgttatctttgattgttgaatgtacaggttgttttgttttgttttgttttgttttggtttggtttggtttggtttggtttggtttggtttggtttggtttgttttggtttggtttggtttggtttggttttgtttggtttggtttgttttggtttggtttggtttggttttagtttagaatagattttattcagggcatggggatgggagttaagaagatagtagcagacgcagagaaaggcagagacagagagagagaaagagagtagagaagtagaggcaggccatgagcatgtggagagagggggaagggaatggggagaggggggaacaagagcaagagagaagcaagaaggcaagagaggaacaagagcatacaggctttttcatagactttttctctgtcatataagttgtagtagcttcattgttacgtaaccatttcaaagagactaaaaaatgtccagataaggtaaatgttcctcatttagtattaagaatcacattaccgttcttgtttcattggtaatttttgttactatgtgatttttgttgctgtgtggtatactgttgtatcataaacatgatgatttcgatacagttacagttttaccgaggtacatttccaagaactagcataggatttaaacagagtacaaggtgagggagggaagggttttgttcttggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaatatttaaggtctgggactgtagttaaacttcactaaggattttcagaaatgtgttgtttcttgtttgttgttttgttttttagatatgggaataaaggtaattttgttgaatcttcattggtgctaatgatggacagttaaacagatagtgtctacgctgtggataagtacacttagtgcttccagaactgactttgaaacgctgtgtattcacttctcactctgtaaatataattctttacaatgactatttattaaaaggaagtcagttgtgatttttacaggattgtgtgaactattcaaactcttcaacctcagaacaagatgctaaaaccacaattgggataaattcgtgactccttgtttcctgtccactaaggaaaacccttataattcatatcaacatgaatttgcttaaatgatcttgtttgcataacatagttcatttgcatggtcccattagactctaccaaagaaaaaagactcaataaatggacattctattgtgagtcttgtaagtagccataaataaccaaaatagtatcaaacttaggtgtgaaatttcacatgtgcatagtactgttaaggtgatacattttttgatgagttttttaatacttgaaaatgattaaaaagcattctctttacatcaaaaaaaaaagaatcacattaccattgaaaaataaaatggcttcaactatttcctttatattttactccaaaatatctacttcctttttattgtggtgtatattattggaggtacttttaaaataccacatgttcataaattaaaacactgtgttagcattcacaaagaaactcacacaatatgtactcactgataagtggatattagccccaaacctaggatacccaagatataagatataatttgctaaacacatgaaactcaagaagaatgaagactgaagggtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacgcagatgtagctgtctcttgtgagactataccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgagctaaatacctaataaaaaatggaaaaaaaaacactgtgttagattaagaatatcccattgcacttagctgagtgtgtatccttgatttaatgtcattgataatatttatcattatcacttaattttttaaaattttattttattagatattttctttatttacatttcaaatgctatcccgaaagttccctataccctcccctgccctgctcccctatccacccactctaacttcgtggccctggcattcccctgtactggggcatataaagtttgcaagacctaggggcctatcttcccaatgatggccgactaggccatcttcagctacatatgcagctagagacacaagctctgggggtactggttaatttatattgttgttccccctatagggctgtagaccccttcagctccttgtgtactttctctagctcttccattgggggccctgtgttccatccaatatctgactgtgagcatccacttctgtatttgccaggcactggcatagcctcatttgagacagctatatcagggacccttcagcaaaatcttgctggcataggcaatagtgtctggatttggtggctgattaagggatggatccccgggtggggtagtctctgggtagtctattctttcatcttagctccaaactttgtctctgtaactcctttcatgggtattttgttcccaattctaaggaggaatgaagtatccacacgttggtcttccttcttcttgattttcttgtgttttgcaaattgtatcttgggtattctaagtttctgggctaatatccacttatcagtgagtgcatgtctagtgacttcttttgtggttgtttagcgtcattctggatgatatcctccagatacatacatttgcccaagaaattcataaattcattgtttttaatagctgagtagtactccattgtgtaaatgtaccacattttctgtatccatttctctgttgaggaacatatgggttctttccagcttctgactatcaaaaataaggctgctatgaacatagtggagcatgtgtccttattaccagttggaacatcttctgggtatatacccaggagaggtattgctgcatcttctggtattactatgtccaacttttggaggaattgccagactgacttccagagtggttgtataagcttgcaatcccaccagcaatggagaagtgttcctctttctccacatcctcgccaccatctgctgtcacctgaatttttgatcttagccattctgattggtgtgtggtggaatctcaggcttgttttgatttgtatttccctgatgattaaggatgttgaacatttttttcaggtgcttctcagccatttggtattcctcaggtgagaattctttatttagatctgtaccccattttttaaatggggttatttgaatttctggaattccagcttcttgagctctttgtatatattggatattagtcccctatcagatttaggattggtaaaaattctttcccaatctgttggtggccttattgtcttattgacagtttcttttgccttatagaagctttgaaattttatgaggtcccatttgttgattattgatcttgcagcacaggccaattcctaaataaaaccgctattctgtttaggaatttttcccctgtgcccatatccttgaagctttttcccattttctcctctataaatttcagtgtctctggttttatatggaggtctttgatccacttataattctaagaaattgaaaacattattttgcttcatacccctacaaaacttcagtctagctctgactggtagacatgtacccccaaggaatacttacttcatatgactgaataatgtgtctttttagcttcagaatcgagacatatttctttttaaccatttattttactttttcccctgtgagagttacttccaagtctttgtatatattgtaaaatatctgaaaactcagtgtattcacacaatagcacttaaatctcactcaagcatccatgaatcctctgaagtttgagtgaactaaattggactcatctgagttaatctcatattgtacagtcagtctaagcctgagccatatnnnnnnnnnnnnnnnnnnnnnnnnnnnnnnnacaaaatatgaaacaacatgcaagaaatatctttattgactcatgtacagatgacaagcaatcccattccctttcctaccaaattctcctttctagttgtgaaagtgtgcttttctccatcaatttgtgggaactaagtttgaatcactccctcttaatctaagtctgatatgtttacatttcaaaacatgaatatttctgttcacctcaattttttcgaaatgggttaaatgagacagctttcctcgagcaagcagagcaggtctgcagtgcagctgctttctccacaggtattatgttgtgttcctttagcatttatatgagtttcttatacctcacaaatagacatttataactgcaaaatgaaggacaaatgccatcacaaaacatgatttaaaacaatattacagttaggattttgcttgcactgatttgaaagaaactttgcaaatatatttatattcatggaagatatgggtagatttctagactacttttgctagaaatgatttttttaaaatcatgcaattcaactcccacatttgttattgtaaggaggacaacttggataacttggatatatcatatggtgtctcagcatctgcactatgagttagtgatacaaatttatgtactatgggttagtagaagatctgtgtgctgggtaatttgtgtcaacttaataaaggctagtgtcatctgagaggaggggactcctgttgagaaaatgactccacacaatagggctgtagggaagcctgtaaggcattttcctagtgaacaatgagggcagtcccgggattgtgagtggtgccatcactgggctgattgttttggattctacaagaaagcaggctgagcaagtcatggggagcaagccatgccctctgcatcagctcctgtctgcatgttccaactcttcttgatttcctgtcttaacttccttcagtgatcgatgatcaatgtggaagtgttgaacaaataaatcctttccttttcaaattctgtttggtcatggttgctatgtatcatagcaatagtaaaccaaactatgacaagctggaagtgaaatcaatctctctttactactcaaatagatttttatatgaatgtccttcttctgggattccttctaacaagaagcaacaatggaatttgaagactggaaagtgagacacatgtttcttggatattttatttgtgcagaaatagtttaaactgtggttaaaactttgttctatatttttaaacaatcactgttatatactcattaaatatggcactatgttacataaagacatatatacgtgcatgtatatattgtgtatatatatatatatatatatatatatatatatatatatatatatatacatgtatttcaatttatcacatattaaccatatagcactttgtctatttcccttcctcatccctacctcttccaacttatatatataaaactttatctgtctatgtaagatcttagcaatcacaaagaagataaaacatacaatatttgtcttttgaagcctgaccagcttaattcacttaatattaatattttccgttacgttcatttttattaaaacaactttattcttcattaaagctgaaaaacaatctattttgtatatagatatattttctttatctagtcttctgtttctggacacctagattggctccataactttgctattgtgaagagcatcactatacatattcatataaacatcgctgaaatgtgtaatatttcaaaagtaattttatatagtccttcttgatccatccctgagattctccaactgacattgatgtttcttgtctttgaattatagcagctacccaagcagatatgacaatattgaagttacacaagatagaaaacatgctgctttctcaattttcaccctctaacagaaataggcaaatgcctgagtgtttaatattgttgattatccactccaaggaaagatagagcttagcctactgattgatcagtgagagaaaatgaagtcctgacatttatgtaattgtaaagaaccttctacattcaatgtgataggacagatgaggactgagccaagtttgtattgtaatagatatgcataactgaacacaattttaaaaggaccatgatataattatcaatgaataaattattggtcttaatgaagaaaatattttgttcattcataggtttatttccaattgcaagtatttcttaaaacaacagactgatcaggttatatcatggattatgtgaatctctgtgcatatgcacatgtagtaacaatcagtgaaaatgaagtccatgagtgtgagtgaaagcaataaggggtctatgggaagagttacacggaacagatggagatgctaaatgatggagttttctcaaaaatagaagcataatgaaaagtggttttttttcaactctatttaattctagcatgggaaaataagaacattatacatcctgccagaaatttttggcacaggaactatgttgttacctgttttcaatatttagtgagtggttgatcatcattatataatcctaaaaaataaaataaaaccaggtaaaaacctaaagtttcattcagacactctacaaattggaaatctttcctttttttatctctatgtaaaactttattaaagtaatgacaagttcaggattcacattaaggaacttgaagaacaaaatccatgagaaatgtgctcagagttgcaaaaggaatcctggtacactaacataagtttttgtgcagtatctcactctcacagaggcatgttttctagcttgctttactttattatcctaatgttctcatctatcttgtctgaggctgttcactgacagtggtcttcctgattacttatacttggcctacatcttcctactggacttcaggcaacagtccatacatatgcttgatccttaccttcacattctacttttaattttgtaactaactctattacatcaagctcttagactctgcctaatttattaaagtcagctccaaagctgctggagaccaaagaaaagggacagatagatcgaggattccaacgtactgaacttactgatagaagtatcatctttgtgatttgttagatctgtgacttgggataagaagtatacatgcgtcttttggttaggaaaaaagtcacttaatcaaactagactatacctccattatctcaagctaatataaatgagtaaggattactactgttatactcgaaaagatctatgtgccactctaatccttttgtctattaagtatacgctgggaaattatacaggaaaaaaaaaagttgttggtctttgaggacaatgacgatgttggcaatttaggatcgctgtagtgaggtcaaagtaaatctattcatttagcctttccagtatctcataagtgtgtacactaagcccaggtaactgctctcaaatgacatataatagtgtataccttaactacactgctcaaggatatcattcccacaattttcttcttctctcttcggtaatcagtttgctcccctctgctgaatatttcttaaagcatgcaaatagcccattgtttattctatctaaaaagaaaacctctcaactctaattcacattatacttaactctctattatttaatctcattagtgcaactttatttaaacttctttaattactttaatttctctcttcttactcacacctgaatatactccaatcagcccttcacccccactactctgctgaaaaagtgtaccggtcaaggtcactgttgattatcacactgttaaatacatagtaattctcactcttcactatacttagaatctcaatagcacttcacacacaactgatcaatttgttttctgcagctttttcttttcagggtatctaagaaaccacacatgcctgctttaccctgtcatttctaaatgtttctaaatactttttcatttgttttcaaggttctcttccatttccccctttatttatagctgtatttcacagctacaatattatattatatagcataattctagaaattactcatcctatttataggagactttagataaaaggattactaaatcttcattttatccaatccctcattccctagaaagaaaattttcattttatttctgtgactttgattatttcaagtccctcttgtacattgaatcatttggtatttgctttactgtgactagcttattttacatagaataatttactcaaaatttagctatactgtcaaatactgcaaaaaaagcttcacttcaaaagcacagtgatactcatatgtatgtatgtacatatatatataatattttatttatccttctttctgtcagtatagattagacttcttaataatatgattaatggtgtaacagagaagtgttgacaatattcataataatagcaacaataatatgataatgataaaaattccaatttcacttattgcaagtatataatcagaattggactttatggatagatcatttgatagatctcttttaaatagctgagaagcttccagattgtttcctagaaaagctcaatcattttcttattttcaccacagggttccaagtttttctcattttcaccaatatttacttattgtttgtttgcttgcttgtttttaattttgcatctatcatgggaaatgacatgcacgctattataattttcatttgcaagattttccaaatgaaaatagtagtatcagaaatactgtgtgatgttggcaggtttgctggaatttctgagaattctagattcttctgttcctatacaaagaatagcacagttatatagataaaagtatgaggggaaaaaagataatttgttaagaaaaaaattttatttcccagaaaggaacttgctaggagcaaagaaaaccttcaaaaactcaagggccatgttgaacaaaagattcgggcttgtatgtcatatttgggggtgggggctttcttgttatggtatattcagttctccatatggcttcattgatcatatgcctcatgagtatttgaaatctccaccaaatagcatgcagctactattgcaatgctttatagttcactgtcagatgatttgaagtaccctctannnnnnnnnnnnnnnnnnnnccatgctaactttggcacctctgtgtactcaacttcaacctcacctgactcttcttcctaaactcaccaaatgagtggaatggtctcagaaatcctttgggagagatgaaagataatgacttgtgatgtttttcagtagagtatacatttgagggtgtcattaaactaccctgtagtggaagaaaaattgtagcaaacagacttggaaaacaaggcaattcttgggcatctaaaaatttgacctctgccatttgcttgccttttttttcttgtcatgagtatctaggtatcatctgcaagatttggcagatgataagaaattattaatacatacatgattatggagaagtgaaagcaggcattgactgtgttaaattgcaaataattcaataaagtacttatatatctgagtcaacaactccaggtctgataatttattctagttgaattaaatattgtttggaaaaagctaaagtaaataccctgacaatgacttgtgccacccaggagtaatcatttctgtttttcatttggcccttggatcactagtcctaattatatatccagataataatgcagaattatatgttcagtcacaagactgttgttataaggacttgctgttaggtctcaacttgtcttgtcaaaggcaaagattctaatatgaatgggacctctcttctcaattcaattggtagaactctctaagggtatgcacatacttgattcagaatcgacctttaagatgatgtattttcttattttcattcagtaaaatacccataggtactgaacatctccattgtcaatcactgttctaagagctggacagaggagagttatacaaacagaccatattcctgatttcatgaaggtttttgctaactgtatttttccataccaaactattttacatgtatttttactctcagatcattgtttctaattatttatagtcttttgaagcatgcagaaaaagatagttcgctgttgaagtgacacagtgttgaagtcagaactcagtaatttctctgaatattccggtttactagcaatatgattttgggaacattaatatatttgaataattctcctaaaagtataatcttatgggttagttcataggataaaatcaagtaataatagtaattgtctagtagatacttccaataaattggagaaatgtaaacccagtttttacatttaaagcttatataagatcatatacatgtatgaaattatcaaaattaaccagtaaaaacagagtttacaggattatataagaaacagtactgggttctttttggccttgttcactaatcagaaggctatgagaacactatgcttgtatggaaggatgctttcctggattgggaaggcttactttgtcatgtttaatagcctgagttgagaattcttccaagtggaagggcatttgacaagaggctggattagacatttgctgtgctgttcatcaccatcatttttcctgtgattctcataggcacagctaaatacaaacatcaagggatggcactgtcctagctcatcctctaagcaatctaactctgaaaggaccttgcaagcaaactccaatttcaattattccccagcatcataagttttagtcataattatgttacaggaaaggcttattccatttttacaaacaagttttcctaacagacataaacataaccctgggagaattttcctcattcttgaaatcctgtttaatattactgaaaggccaagccagcttctttcacaatgacagagacagagaggaagaaacacaagacagaaagaacagaggaaactaaaggggtcctgcatgatgtatcaatctcccttgagcttatttcactctttcaaatatataatttttaggcagattaaatatattgttttagagtgtgattgattattgtgtttgctcattgcatctcattgagaaatttacatgtaggttcagtcattagtaataaataactacttaaaactgctaatgccgcaaaatagcttatatataactaataccattttataacaatatattttcaggtcctacttttataatctgttatgattttttgcttatttaactagtgtccacagaaagaccaaaatacatctaccctacagggaggatcagaacacttactaacaatttgtgcttctagtcattttcctgatattgaagcaggacttaatgaatagtaagtgaaatctgaacagtcacaattcctgttttgcgcatttcctttcttatttctctcattgctttttcagttttcatgaataatctctgctttaagaaattcatgctatatacactgtctttcttttcactacacctgctgttaaccactttcaatagtttgatcattcctataatgagtaaattcttcagtttacataccattagttagtattcagtatccattcattggttaatttgtaaaacatttataatgtttgcccatttcttcatgggttaaataaactgttataatgattgttttatatgtatatgtgtgtatatatatatatatatatatatatatatatatatatacatgtgtgtgtgtgtgtgtatgttatgaattttccctgtttagaaagaatattactgtttcagaaacccaatgagatttttcaataggtttacttgtcttatccaggtaaattttgatgcattatatatggtcaaattctgtatatatcttggataaatctagagcaccaagaaaattgtatctcataatcatttttctacttttaattttactttttactaatgctctgtttctcttttgttttgattaatttgtagccaataaatcaatacgttatttcttactgtaggcaacaatggttgagaatttgattttagtgtgtgacaatttgaaattttctctaaacaaattaatgttctttggaaatctaattttccttcagttggcaacaacaaaaaaatctgatttgtcagtcttcatttcttatctagttttgagccgaaataaatgaagactcttatgccctttggtagaaaagctccttcatcgatataaaaatttttgttctttatttactcctgccccatggctaaaattgtagaaataaaggtatgggctttatttatctgtctgtttatctatgtgaactaagaaatatacctacctctggatagtgtgagtgtgtaatcctttctatagatgacaaaaattctataaaatctcttaaactaaagtaaccttgatataaaagctgcatatataaatataacctgctcaatacatctagtattacttgtacatataatgatttcaattgctatcagataaccaataaagggatctttaaggaggaatgcttctttagctctcagtgttctttatttgccttagttgtatgtgaggggcctcatgagttttcttccctctgggttaacatgtctactggtctactgatattgtcattctacaagtcttgatgatgtaacattgttgttgaggtatcatagatagatattccttgtcacatccatgagttagcacagcagctctcctggtcctttgtatcctacagtgtttctgccctttttttgcaatattccctgagccttgggttcaggagatgtattataaatgtatcaattggtgatgagaacccaacactaatttgttctatgtctttgatcacttgcagttttctataacattcttcttgcaaagagaaatttctaagatgacagatttgttactaaaacaaaagttatggtagtaggttttcatataagataactaacttaacccataccgggtagttgtgaaaggtagtcctcaaaactaccttttattcaaatctagtttagatcctctaggtcttgtctcctaagagcatgatgtattattcaacaataaggacttatgttcaactgctaggaggctaccaagagcaacagcaatagtcaatattatttacagagttacttgaattcccctaacagctcagcaggggattttctcatgcttggcattgagaggttgctattgttattcttgttgttgttattgttggatagcatatggcttctggagggaatgttatcagcctaaatgcaataacttcatttgcattcctgtccacattctctgtactacctggttttgtgtgtcaacttgacacaagctggagttatcacagagaaaagagcttcccttgaggaaattcctccatgagatccagctgtaaggaatttttttagtgatcaaaggtgggagggcacattgtggttggtgccatctctgggctggtagtcttgggttctataagaaattaagctgggcaagccatgggaagcaagccagtaacattcatccatggcctctgcatcagctcctgcttcctgacctgcttggcttccagtcctgacttcctttagtgatgaacatcagtatggaaatgtaagctgaataatccctttcctccctaacttgcttcttggtcatgaagttttgtgcaggaatacagaccctgactaagacaatccccatatctaattcaggtccataatttattttccattggcctagtttaatcttctgctgaccccaatctctacacttaagcctataggctccagtcaggaggcacatcacccatgtgtaccttccttcattctacccaggccatacccaagttttaggctcactccattcacattccctgtgctctgaaacagcatgctgtgcccaaatcatatacaatactaataaaagaaatcaacatgtccaggtatcatggaaaaagtataaacaatatgaagcatcagtcttatataaatattctccaatgaaaattacctagatgaattgcagggcaagaatttacaagaaatatcataaacttcattaaataataaaaggaatttttaaaagacacacagaaacaactcaatgaactaaagacaaatgaatgtacataataaacacctgagtgatgcaaaagaaaaaaatcaccatctaagactgaataaaatggtgaagatgattcagaatttgaaaagcaaatttatcaaagagctagacaatcagttgttcttacaattaattaataatctcatttttataactttaacagatcacttgggatttcttttgtagaagactttttcacagtttatcgtttaagaaatttgtttctaaacatttaatatgcatataagaaagtagtaggacaggacactgttcagtattgtcagataaatcatattattatggaaatgtttccaagaatactgttttcaaattatctctatcttaaaattacttaattgaaaaagaaccatatattttcaatgttaaagcaaaagtataatctctaccctgaatcatcagaacctttaatttattgattgatttactaacgggtaggaaatacattgatgacaaaaaaaaatgagaaacttctgaacattcatctttttcaattaaaataaaagttaataacttacatttaagcttgacaagttcttgaaatacattgcagtaaaataacctataaattgttatgtggctcagggaattttcttggtcactcttcatttttgtgtagagcattataaagattttacaaacgctgtgttaatgagatccataaatccccttacctggatggtgtctcaattaagtctaacatacacaaatatctgaagcaccaccaatctcttccctctttcagacactttccactctgatgtgaattcaacagggcacagaaatacaatcaattatgatgtttagatgctctcattttacttcatgttaatgccaaactcatcatcaagagttataatacagtatgaatgcagtatatgatctatattttaatataacaacctagagttatattaaactatatgtaaggattataactaagggctaaagtctaagctgaaaatgagatggaaactggtggtagaaaacttccaaagcttcctttcgaagatgctgctttctggctataatattagcaagctttgtccctcctcacatatccatattttgtccaaaatctgctcttttctgaagaggtggtctgataacaatgacagcaatcatcaagtcaaccattgtttttcccttgttagtgatatattttgagataaacgcatgctgtaatatcactaataaaaggaaaaatataaacattcagtgagctgctcctgtataaaaaggactggcaaatgtgtgtgcacacatacgggaatgatgccttttatttcctgtgtgttacctgaaagtgtaatgccttaagaagtaatgatcattctgctactttcgccaatgttttcaattcaataagtctaaagatcacaaaatggaaaagcatgaccatttctttagagttgttcaaattaacaactcacctttatgtgttttagtaatttaatcaacactttttattgtcattcaacctactatcatgtgtctgatttcatgcaaatcatacattatttgatacccagaagggcttctttcattgtcattaactattattcacccacatatttttaacatatttgtttgtgtggttttcttgcatatagtgctttcaaactaggaatctttaaattattgttaggtgaaaggctaccagaaaaagaaaataacagcagggctaccctcaaacccattatagccttaaacatcggatccttctacctataacttcaggattctgggcttacaagtgtgttacctgttttaggcaaggctgattgttgaggccagggcctcctatatcctaaacaagcatcccacaaactgtgctacctcccatcacactcaatgttcttatgaaccaaacagtaaaatcaggtgggctttatatgtagtatttttttattttatatttttggtagtaattttaaatgttattgttttgacatacaaagtatgttgaatttttaaatataaaataaattttatttttattttttattaacttgaaagtagtgactaaattcagactataattactattaatagctctatgtgattaacttagatttaggcataatgtagaggaactgggattcattctattagtcatataatgtagttatacaatggggtcattcctcccttgtgacatatccaaggctgttatcaattaatcttaactattataaaagtaacctttaaatgccaaatcatccattcctgcaaactgttactctgcttggaccagtcttggagcaaaaaataagccccacaatatacagaagcttttccaaacaatcataccattattgttcattgaaactgtacatccctgctcattcattttctatcttgaaatgatgttttacaagatcaaaaaatgtgtaagcatttaccagtagaaggcaaaatgggtatgacatggttaggttaatgacatcaaatatgtcttctttgagaaaattaattctctagatggtgttgatgatgttaagtattctggaagtatttttcattgtgctttcaggcatgcactatatcctgtcatcttgcccaatttcttggcaaaattcatcaaaggagcttgtgtttctccattgtaggataactccttgaaacctagtgactttttaactctttctgctactttgtcactcttctgtatattctttttatctccttttctggcatatattctttccttggccttttcatataagagtatgcaaactcctgcttagtgatgttcctcatgtcaggttacactcttatcatagatgatctcacacattctcttgattttccacagtgcatctgaatgactagctttacattttgttttgctttttgatctctcttgctgagctgaaaagagtagctcttccaaggacctttcgaactccagttactgattcagttctccacttttgcagaaacatagcaatttgaagaataagaatatattgttctttataactttctgtatttcctgggatcatacagagacacatgcacacacatatggggcaggggatactgatggtgatagggaaagggaaagggagaggatcttcaactaaaggctgttctgctttggtaggtctaaaaaggtcccattttccatgtggtatttttttttctaccatagctcttccatattgcttatctctcaaagagtaagttgtggaaattttgcatcatggcaatcggaattataagataataaaggtggaagttaccactgtttttaaaatcttggcctaaaactggcttagtaccaggcttctgcaaagtgttatacaaggatctgtaaaatattccaagtttgaaagatagaatagctatttcaaccgaaggttttgaaaagaaaggaaagggaacagttgatagaaatgaatgggagataggaaggaaagcagatagataggctaatatcaactttaggggaagaagaaatattttgcagtatgtattttgtggtgtactagctttactttgaaatgagagatgtcattcctcaattttacacctatctgccaaacagggtatttatctcatattttgctacaccatcccagccttcatgatctctcaatcatatgtgttctttgaaaactcaaagccatggggcacttagtcttaaccaactcaacacggtttagtgtttcacatgccagaaatgatataacaaagatttgtgggacacataaatgaatgtttcatgctcttaaaacctaattgagactacatgttcaacctatttttcactatttatgaaaaataaactgatagtgtcagactatatattttctttgaaaaactcattgctccccataagacaggcctatgatcatagttttagaagattcataaaaagagaaaatctggggattcagatatcaagaagattccaggcttctcaaatattgaccagtagcataagtgaaatctaatcatttctcttggggggggcatactttgtaataatttaagtaactttgttggttaatttattatgctaccttttacttctacttgcattgattgttttatcattaggttttttccttttttctaacatatttttagtaattatttgggaatttcatataaaacaccccaactgcattcagttcccattcctctcaggttcaccttaccctttgcaccctccctaaatcaaaacaatacaaaacaaaaccacaccaccaagtcttagaacatggtcaaactgccagtggcaaaccccttaatgagaattgagtccttcctcttcgcccaaccccaccagaagccagaaactatgagtagatacatttcagcatttttcacacttcttgtggactcacttcaataattttctgtctaaactgcttctttttcgttgcagaaggaggtgggtggcttgtcacagaagcctccaatacctctcattcttagttatgagtttgtacccaccaataacactgcaaaagaagctcccttttccatagtagtttctaattttccatttaagtactttcttccgagtgtagcaacacatataacatggcatgtatacgaagattataagacaactttatatatattttttattggatattttctttatttatatttcaaatgctttcccctttagaggtcttcccttcagaaaccccctatgccatcctcctatcccactgcctctatgagggtgctcccctacctacccacccaaccctgtcttccctttctgccattcctctacactggagcatcaaacaccctcagctccaagggcctctcctcccactgatgtccaacaaggccatcctctgccacatatgtggccagagtgatggatccctccatgtgtattctttggttggtggtctttcattggtggtccagtccccaggagctccaggggagtgtctggcttgttgacactgttgtgccctccatgaggctgcaaaccccctcagttccttcagtaccttctccaactcttccataatggatccccatgctcagtcaaatggttggctgtgagcatctgcctctgtatttgtcatgttctggcagatcttctcaggagacagcaatatcaggtgtccatcagcaactacttccctacatacacagtaatgtccagatttgttggctatatatgggatggatccccacgtgggacagtctccaaatgacctttccttccatctctgctccatactctgtgtccatatttcctcccatgggtattttgtccacccttctaagaatcattgaagcatccatatcttggtcttccttcttcttgggcttcatatggtctgtgatttgaattttgggtattggaaacttttgggctaatatccacttatcagtgagtacataccatgtgtgctattttgtgactgagttacctcactcaggatgatattttcaagttccaaccatttgccatttacctgcaaatttcataagacaatttttgagagttggttatcatgttccattatgtgaactctaaggatagaactcaggtttcagccttggaaataagcaccttcatttgaagataatctgttgacaatttacaccacataagtattttccagagaagcctgaacatgatggtgacattatgataagtgaaagaagacaccagtacatgcaaagatgaggcaatatgataatgagctccaggtcaaacagagttagcaaacatatgtgaggctggctagcctaggatatatactgagactctagctccaaaagcaaagctgaaagcaccaaagacattgagaaacaagtctgacaaaaaattgaatgagttggctgattttacaccaaaattagtaaaagagaaataattcattaaaaagaaaaacaaaagctgtggatgctattagaaaagatgagtgcataccaagtgtgttcctttgtaactgggttacctcactcagtatgatattttctagttccatccatttgcctaagaatttcatgaagtcgttgtttttaatacctgagtagtactccattgtgtaaatgtactaaattttcagtatccattcctctgttgaaggtcttttgggtttttttttccagcttctggctagggtggatagagtagtaccctcatagaggcaggggtaggggggatgggataggggaaaacatttgaaatgtaaataaagaaaatatctaaggaaaaaataagcttgaaacaattttgatgttcttaaaaaaaaaggcagatccttgtagtcaaccattgaactgatcttggggatcccaaggaggagttagagaaaggataaaatgatctaaatggatttgcaatcaacctcataggaagaaaaacaatatcaaccaaacagtcccctcagagcttccgggaatgaaaccaccaaccaaagagtacacatggaggaacccatggctccagctgcttatgtagcagagggtggccttactgggtatcagtagtaggagaggcccttggtcctgtgaaggctcaatgccccattgtaagggaatgccaggccgagaaggcaggaatgggtgggtgggtggggaagtaccctcatagatgcaggggaagatgccaggcagtggtggcacatgtctttaatcccagcactcagaggggggaggggcagaggcaggtggatttctgagtttgaggccagcctagtatacagagtgatttccaggacagccggggatacacagagaaaccctgtcttgaaagactaagaagaagaagaagaagaagaagaagaagaagaagaagaagaagaagaagaagaagaagaagaagaagaaaacaaggggaggtgggatgggatagggtgtttccaaagggaaaccaggaaaggggataacatttgaaatgtaaatagaaaaaaaatctaataaaagaaaaaaaatgaagaaaagatgagaagaaatgcaagcatataactcttcctttgaatgaaatcatatggctcatgcaattttatcacattgaaagtctatcaatgatacttaatgagaaagcaaaatagcttagtgttagtagaaatctcatatggattgatttaagatggttggagttacagacacatgaacaatttaaaaggtattggggatttggcttgaaagtgttcatgatgatcaattttgttttaaaatacactgtttccaatagataataattgattttcatttcaaatatttttgtaaatgtaaaattatttttctcttacacattgcttcatggtgctttaaattctaaatatgatttcatgagtctccaaggagagttctaaaacatctattctcctgggtaatatatgaatagtatagaaagatagtgtttttttatctataggataacccttcttaatgttaaaaaccagagcaagatatcctcattttactgttagctgactataacatttaacggattagtggctgcgtaatacttttaagtcaaagaactgttttgagatactgatgttagctataatattctccatcctatgcacacaagtgcaaaaatatacacacatttttacacacaatttcataagattcctatgtccctgaggcatatgtatggtatcctatatagaatcactttgtataaacacagatggcataaaatatgcatttcagattaataattataataaagagccaaagggaaaagatgagaatacatagttttcagtttttttgcttagcaacagacttctcaaacttagctcccagctgaactgtggttccacccctgcattctaagagaacaatttttctcacatagaaacaacatatgaatcccaggctttggcagtcctctgccacacattctcccctatattgtgtatgctaaatcagaaaggcataataaacttctgagatatataaaacaattgaaattccactgtaaatggtggtctttaatttttacataaaacatattctatgcattttacataaaaacacagaaaatacattttattagtgataatgttgtgccaggtagcatttgtgaagccaaaaaaactaccaaggagccatttccactgtaatcaggttaagggtctctttattacaaacttgagttttggacttattcaccactgacccataggacagtttggcgaagcagcccaggactctcactgagacaaggatttatagaaaatggaagcaagtaggggttgtgtgtgttggttccatcctggcaagcatttaactgaatgtctattgtaagcctacaggtgggggctctgaagagagacagcatacaatcacaaacagtctgaaacaatcaagtagagaaaataatagtggaaatacacaataaagttggattggtcaagtgttttactttttcgcagaaaacttcaaaggcacaggccaaatatcaaaaaacttcagagatcaatttaaattaaataaaagcattccatccagcaaagtaattcatggagtagagagagagaggaaaaaaaaaaaaagaaggagacggaatactagcaaattgttcatctgaaaaagagctaatgtatagaatataaaaataaacaattctgttgcaagcaatagcaatatgattaaaaatgataaaggacctgtttttgagaaattgtgttggtgtataactcatggtggctatgaattcctaaacttctttaacttcccaaatagagaatacaggtgtgacccatcatgcccagtcagcagagatacataagcattcctcaaaaggcaacatacagtgatcaaagatacatggtaaattactcagcattactactcattgaggaaataaaaattagaaccttaaatgattattctcactccaattagaatgtcaggggttgttgttgttgttgttgttgtttaagagaaaacaagaagaaaaggtaatcattacattttgttggtaggaatatacacttctgaaaccattataaacaatagagtgcaaacttaaaacaaatttctatatgttccattcattgttttactgggcatgtaaccaaaagacatgaaatcaatgtagaaacaaaacatctgccctcctgtatttgtatcagctcgatttataataaccagaagttggaatcaaacttctatttttgtctgaatacttattttgttttcccctaaatgcttaagaatgggttaagtcttacaaaaaaaattccatgctgaattacttgactacacagtattgagttatagattcaccaatagtaacagaatatgcattgtacaataaacacatacgggaaaatggaatgaagtgcatgacattggttttagaatacacagaagagactgggttttaaatacattctttctatgttattaaaaacttatgtctcatctgaaatatttaaagaaagacaagagatcttgtgagacttttaacattcctgaaataattgtattagctgacaagcacccatactatgttaataatcttcttgccttagttgttcagctactaattctgagacaaactattggattctcaagataatatcagtatcttggttgaatatatcatttatacaaatatttattgtgacagctccctttggatagcatgtagtttaatgaagaagaaagaaagaggaaacctttcaagatttttaaaaaatagttctaatcattaaataagttgcttctataaaattatttctgtgttagttacaggactgaataaagtactataaactgtttagctctgttaccatctttgtggtaatagactgtgtaatggcaatattagttgatataattaaaataactgttcagagattcacagaagagtttgagatggggggaaaaggggcaagaataaagaagaaaaatcctcaagtacaacattttccaaacagaaaacattaaaataaatccattgaaacatactatctgtttttagtttctggaaagttggatttttgctgctggatatttagaaacatgtctatttaacccagagagaacagacacctagaaaagataccatcacatccatctttgttggataaagtagtttattaggattattataaagaagaatcccaagccccagtcaaccttcttctcctatgaaggtactaaaaacacatcctcctgggacaagaagaaatgattcttatcaggataaaataatacttttgcatgtctttgtctagttgtctagtttcatagacaaaagtttttttaaaatggacttagaaagagtatctggaataattttattgaagtttgagagcaaaagtaataaagtagaaaagtaataaatctcaatggcagctgttagaaagtagggaatgaatgagaaggggagaggaaaccatgctttgtgatcaggaaagcaagcaagttgtccagtggatgtctgcaaactgctgcctgagggtggacagatgttatcagaaggatagaacttgagaatatgctaagggtcagagcaagcagtctttgtgtattggctggtgtctgaaatagagatagaggaagaagggggaggaagttacatttttgttcttagaactcagaaagcaaaagacatagcagtaagactctagaaacaactgcattgaggtagtgacttctgggctatataaaaacatgactcattaaggagatagctattcctctcatcatttcaacaaaccaccttataatcttctgactaatttagaatggcctgtctccattcaaggccaaaaatatcacacagctcctattcttctgaaaaattctagctgagtagattttaagcaaaatagaaaggcaaataagttatgggaacattgtggggcagagaaaagagctctttgccctcatctggctgaagcatctggacaactgagaaacccaatttccagaataattaacatttactaggcatgctgccaacataactataatatgccgtttgcatagatatattttttaactgcaatgacttttaactacctccaaatgtctaaagactaagacctgatagtagaataaattgtatatgtatatgtatatgtatatgtatatgtatatgtatatgtatatgtatatgtatatgtatatgtatatgtatatgtatatgtatatgtatattcatgtatatatgatgcaaaatatagcctgtgtaatattgaacagctcttctatatgtgaatagctgcacaaaggaaaaataagaaaagcattgcaaatataaactaatcattctgtcagagaagaaaattgagtgtggtcttgcatgacattatgactttttctaaggagttattctacattatatgacagaacatcatttttctcaaaaacacaccatatatgtaaattataagaaacagaaaatgctagatgagatggtagggtaaaacccattagtagagtatgtgcctggccctcaagggaatcagcattcaattatcaacaacaccaaaaaaaaagcaagaacaaataagaaacatgaccagaaagccattgagatcaatctgaagaaaatcaaatagggaaacattaatattatgtacttgaagtgctgtgaagtataaccttttaataatatgaacatagcatacatctgcttttctttctgtctaatacatattcaaagtattgttttaaggtgggtgtgtaaaaaagaaagttctgagtgagttctagaatatggaggcaggaagaagcagattaggaatcaggttggaagatggtgttattctatcaaccacttgtcaacttttcaaccaggcatcaatgctagaatacaaggagcaaatgatattccctgggggcatgaataagaattaaaagggctctgcaaccactgagtctcattagagcttgcagatatcacaggacaacatatcaatataatgtaggtgtgtatatataatgtacaatgtatacattcgaacactttcaatatgcatacagaaaaggttcttacaaaagattcactttggatactagaacagaaggtgagaaaactcatttttgtgtgaatcccagaggatcaaagagtcttcaggatttctggtttatttttgtactctaatatagctgtcagtgtttgtggcataatgtgttatgttatgctaattcagtagccctagaggtttatcatatcactgatttggcaggaattggaagaattgacacaactggaaaatctagcacagatccttcagggaatccaagatggatatctaatcctgacagatacatgctaaattcttcacaggagacagtgctacaaaatgctactgaagttcacaaagcccaaagtttaggtgtaaaatcatttataagtgaaatgatcaattgtacttttgcctcacctatttgatatacaggtttctttcctgacattagtgtcataggtgactttccattttgtaaccattcacattaagagaatgactatttacttatctatctatcaggaaatatgctgtattcttctaagtcaacagtgagtaggacaggccttgttctcacagaactctcagactgaataattccaatgaggtggggcacctatatgatatatatgcatataagtggtagctactttcctgatgttgtgataaaacatgatgaccaaaacaatgtcaaggaagagagatgttttaggcttatggtaccagatgagtaaaagcctatcacaacaaaggggcagggcaggtatggtggtaggaacaagaagcaaagagatcatatcatcagcaacaattacaaaacagtgaacctgaagtgatccaatgctatgaatgcttaaaacccacccccagtgatgtactgcacccagaaaagctgtaatatctcccaagacaacacaaacaattggggatctggagctcaaagatctgatcctgtgtatgacatcctcattcaaaacactgacacaaacagggactcttggatattctactggtatttatttagagatgggaggattggccagtaggttcatgtggtatcagcctaagtcttgtgtaggctttcttcagaatgtcctttttttatttcttagcatcatgagaattatgcaaactaagcagaatcctctgcgagcacagagaaagtaagtttttaaaaatacataatttgctggaccaatatatttcagggagtgttgatttgagtgaggagctattatctatcatgcattagaaagcagctgacaccttgctcagatagcatgagattcacctgagaagattatgaaaatacctttgaaaaatgggacccaaagaatttttcactggaacatgtatgtactacacttgctattacatttatcctgttgcttccatcattatactcttttgaaaacacaagaccaggtacctgcagtgaattattttgcttcagtctcttgaaattcagtctagggttctccatggtaatgcatgagtaagtttgtttctttagagtactagagtgttttgtgttggttgttgttttcatgtgtctttgcaatttacatcataattgagaatagctttaaacttctgacccttttgctacttcctgggtagtagaatgataggtatgtaccactatactcttcatataattctcgaggttgaacccaatacttcctgaatgttagtaaaccactcagccatgagattcataaagaatattgaggtggctccactttgtccccagtattatgaagtctggaagagaaacattctttaactttgtgtccaagactttgtgtccaatgaaacataacattttcacctgaagaatttttcatttcttgtttatttactgctcctaatattctgtttcaagtcagacccacttgcatctaaattggcagcatgcacatcagagattatgcaaatttgaaaatcttactacaatctttctaccctgattagaggaagagatcccattatccgttcatattttagaactagccatttagtcaatttcctggagttatacaagagaatactgcagtaagaaaatactgcaaatgttgtcaaaatagaaaatacaaatgaatccctgactagtcctaaaattgttcttatgattttcatatttgatataaatatgcccgtgagcctttcagaattttaccctactcccaaagataaagccatcaatttccttacatctgtgcctatgtgtgccatgtacatatgggtaaccacagagacaagaaaatggtatcagatcctctggaactggagttataggaggttgtgaaacatctgatatggtattttacatagagtaaatagtacttttctcataatcacacttgaattaggtaatgtgattccacccttgaaaaagatcagtaagtaactttgaatcatatgttatataggccctctaggactgttgtaaccaatttcgacaagcttattggcttagaacagagtatattgaattcctttcacattaggaggctagtaactctaaactaggcttacagaactatagtctagtgttcataggactatgcttcttctgagggacttggaataatcatgccttatcctgtcttctgtttgcaatttagcatcaggcttcagctgtcatattaccttctgtctctgtagattctacagtatagaaaaaagttgaccagcttttctcttacaagaaaaaatgtggttacatttagtgcttacctgtctaatagaggaaaatatatctattcctgagtccttaacttactcatatttaaatccatatattttagtatataatgtcatacaagttccagagactaggacctgggtattttaggaagccacaattttattagcaacatcatgcaaatctctggtatgcatttcttcctatacttgagactttttgtgtatacagagtgtttcaagtatttttcctctattagcctcccaacttataaattatcacagtttggattgttatacacatcaatagtgacactcttaagtttatcaatatttgaaatatccagtattcaactgaataatgtttcaacaatttctctaaaaccaaatgaacatatgtaaaaggcatctgtcatgacactgagtgattttttttaaatcatgtttcctttaaatcaatgaggcttagaagtagcactaggattggtctgtcctaagaaataaaatgcaaataggggtttgaaattaatcctgatttttcaaagactgtcttggcttccaggaagcatagactaaatttagtgtttaattacagtaactattcttggctgttatttcttacataattatatgttcttcaaaccaaccccaataaccatttcttcttactatgatgctattgaaattttatctccattttcaccatcttattccatggagcctttattataatctatattcacattccttttagaatgaaataaagcaaacaaacaaacgtgtaacatgtataaaatctagcttcaattagggcccatctgtatctttgaggaccaaaggaaaattccagatctgaacatattttataactacaaaagcattttaaaattgcatttctatctattatgaagcttactattatagttagataccactagatgggaaagatatgataattaatgccactataacatgttgccctttgaagtttgttactttctgactttaaaaattcattgctttattttaattattttatattctgttcattggtgttttgcctgcatatatatatatatatatatatatatatatatatatatatatatagctgtgtaagaatgtcagatgttagaattacagacagttatgagctgccatatgggtgctaggatttgaaactaggtcctctggaaaggcagtcttaaccactgagccatctctccagccctcatggaaccctataggaggaactaaccagtaccccagggctgtatctctagctgcatatgtagcagaggatggcctagttggccatcaatgggaggagaggcctttggtattgcgcagattatatgccccattacaggggaattccagggccaggaagcaggagttgggtgggctggggagcagggccagggaagggtatagggggatttggtgataacatttgaaatgtaaatgaagaaaatatctaataaaaaaagaaacaaaattcattgctgatcaatggcagtagtaaaacataaaatggaatttgtaagtcaatttttgttaatgatttctgcattaaaaatctataaactcacttttgcaaccttaagtgtatttctggttatatttccataggatgaaggactcattaggaaagtgtttcttcatttactcactcagcttataaaaacttaacatagtatctgaataaatgtgaccaatatttgagatgaattactgtgcctattgtgttgaacgtttgaaacctgtattgccaaaaagtgttcaataaaatttaaacagggagctaaaattgagccgtcttttaaatttattctataaatctaggtcttttattacatttcatattcacattatcagtaaacataaatggcagtaaaacatgttacatatccaaccttaattcaattatttaaaaaatagatacatgtatttgaatgagatgtaaaacattttcaggaaaactttgattcattaaaaaaacaatttgagatctggagagatgtctcactggttaaaagtacttgctgctcttccagagtttccaggttgagatctcagaacgcatactagtcgattataactccaattccaggtaatgcaacacatttcttctggcctttatgcatacctgaatgcaagtgatatacatataagtagccacacacatgtaaacataaataaaaacaaacaacatttatgaataaagaaaaataaaatctttttgagaggcaatttgactctggggggggggggaagcaatgaattgtaatttcaattcaggaatcttgaattcaaactccatatgtaccaaaatgtattttttttgaaataccaatatctaaaataagtgaatattgtaatctatttaagataactaattccttctgctttgtggtattctttgttgtagttttaaaaaatattttcttataggggattggatttatctcaaatgcttaccaaacaaacatatctcacaacaaggaataaactagatatggtagaatacatacacacacacttgtggttccagctacttaagttagaagagtcagaatttcagactcatactgaggtaaatttgaagccagcttgtgatacagtaaaacctgtatcaaaatatttaaaataaattaacaatcctaaaatttatgaaattgtcaagaatacagaatataatgaaatgccttaaatattttaataaaatctagactaagaaaagtaagtacactgcaccacattaatatgtctatgtatatatgcttcacaaaacatataacactaagtatgctataagttttacaaatgttctctattttgttcaaatatactgtttattttattaatcattccattcatttacatctcaagtgatatcccatttcccagttatcccttcacaaactccccatcccacatctgccctctcctccctctcgtttgtctctatgagagtgtcttccaccaatcttctctcgccctaccagtccagccagcatccccctatgctgggacatgggaacaatcattaaaactgttttacactcacagtttgagtatcatctgaaagttttaaaaaatcacttactctcaacatgtagagatgtgtccctcacttggtttataaattttaacatcttgtaatctagtgtcaataaatgcaaagttttctaagcactcatttttacctaccatgcttcctcctgtaaattattttaaatttcatgtgtatcatcatgtatttttaattttcacttcttatagacatagctatagctatgtagcagttttgagcatattttaatgtgtgtacaatgcattatagtcagatactcttctgtatttttgacttgataccttgatacttctcattgttgataaactgtaactcaggtttgtcggtcttaactgctctgctgtgtctcaatgaaatactcttaacactttactatgactttaatttatattttattgttgtagctcagattaagcatattctaatgtaatgaaaatttacatgtacatctatctcccttttttctaaaaaaaaaaaaaggcatgtttcatttgtatccacaacccaaatagaaatgaaaacactataaagccaatatacccttggagttctcatatattgccaaattgtcttcccaaatatccactgaaaacaattgatacaacagcattatagaagaattctaaatatagataactagtaaatatcaataaaatatctcattttaaattttattattttatcattaatgaagttgaaattgccatggttcccatcatttaaatttatcctagacgtttcctactttatcttagaagtgtggctgttaataactattatgaaagctttctactaagtttcaacaatttttatctttctatattttccctgttgtgaagaagctttaaaatatattgctttcaagttaatatttatctgtattatgttctattttaaaataacaaatgttttattttatgttctagcattgcatttagttcacttattgatttgtatattcctaaagtttaatacatgtataattttggatatagacatagctctttgtgtgaacttttaatgtgtaatcagaacgaagtttattactgttaacactatgaattgtaccagcatcctttttttttttttttgatactggatcttttattgccttgtttttaattccatttctgttatatcacattttcagatttatcaaggtctctagctggattacatatttctatctcatctgtattcctcttgtatatttaagtgggagaagaaatgtcttcaaacattgagtctttccatcactttatctgatccatttctctcattcggtcactgttagtgtatttcactaaaatgtcagtttttctcacaaaggcttacatattgttacatttgtccttatgcacagcataattttgcttttctattaacagtcctatgagaatgaatgcttagtttattggcataaatactgactgcttccttggttttccaaaataaatgcaaattagacctgtttgaaccattgaatttgcaacataatcatccctacactagtgcttttatttgattttgaatttattaaagtaaccctttttttttagtgtgatgctatataatatctgtaacattagcactctggagactgaggtatgagaagggaaagtttgaggccttgtgaactacgtgataattttctctctaaactgggcttagtaatgaaacattgtctgaaaaattacaaacacaagtaacccaaattctctaaacactttactaaatattttgtttgtttgtttctgatgctcgattcttgagtagggatacagtttgggttaacttgttaagctcatagtaaaagctcttcatttatgctaatatatatgtatatatatatatatatatatatatatatatatatatatatatataaaacaaatctaaattttcttgctgttctcttcatggaaaccacactggagataaaatctctggagtttggatgttattcttctgacagttcattttcttcctttgaatttagctgagttttatttaatctgtcattttagttattgggaaatttaattaccatgtaattaaaacaagcatacactttccacatacaagtatttaaaatgtatggcataatctttactttgatcagaatataattttagtagtagtactgataggtgtcatatttggaccacatactagttttagttcacataagggctttagctccatgaccattgtttacaagccatatcacatagcatgttactttccatataaacagttaatgcatatataatacagcaccacttctatttttgaggctgttttaaaaattgacatgtcaaaatgctataaattatagatgaaaaagttcttaagtaacatactagcttttgcataaaattatatatattgtattgacatgtactgagatttcttctacatatactgtataataaaacattgagatttttaatttgacaattcacagtatagttgcttggagtgggttttttttttaagttttgtaaaccctgttatagaaaatgtcatttatataagtgatagaagtctctttgaaagtcaaatacagtttctatttttaaatgaaaaccaatcttctaaactcaataccagtgaaagttaatcagtaacatagtgattacagcatgagctgtttatcattggaagggtgagtctcttatctttgtggaacatctgatttgaaaagacaaagtgaaagagttttatagtcatgccacccttaatttgtgaactgtccctaaatataacccctttgaagaatggcaacctctgttaactgtcatcttctttaaaaaatttagtcaatattatgcctatgcatacatatattttaccctaactcccatctaagatatatcacagatttagcatttatgtagaaggaataatcagaaaaccctcttgcagcccacattattatgtaataagaaaaattgttttaaaatacagaaaagaaagaattgggtcaaacagctgcttcccaagtgttaaatttctgtttccattgcatccattattcttcctcattgaaactgagagattattcatactgagatacaactttttcctcaaaccaaggcttcaatacttgatattttagtagtccataataagagatgattgaaaaggtgtcaatgttagtggcaggaacaattcaccacatttattctttgcagtgacctctgcaatcatgcccctgcctgggggaaactcgtttttccttcctcctccaccttccaagtacttacagtcaaggaagcacatttttcaaaggtgaccatgccttggctattcagggagaatgacagaggtaggcttctaatacatccatacttagtccaggtccattctcagagcttcagaattggaagaaaatgctcttccattgcagtctgagttcttaaatgggaatcaggcgaacttgcaagctgctggcatgagctattttctgatatgtgattttaaaaatagaaaaaatgctacacagggacagaagaggaataaaataaatgtacagagagagatagaattgagatatgaatagtgacttatggtttattatgggatttaaatcagtcatgacatctcaccctctcagctgtatccctgaccctgagctctgtgtgagaaccacgtgtgtgtgtgtacttagaaaattctcatttgctctattgttttttttttaaatgagtttctgtgacattgagctaaaggaacaattttcagtttctttcatattatacacatgctgaaaataataggagctaatcataatacattttataactattcctttacaaagtgtgatgctaaattattaaatggaattgattccccagagagcaaataaaaatagctcgtatgtgtatattgaattgtgtttgaatatttctgtgtgactcctatgatctggtcatagtattaagtaagcaacagtgaatatatagaggtggatgattaaattataatatccatcattgctatggatattatagacaataaaattcaagagtttacaaaattcaaaaataattttaaaatgtgagaaattctatgatgaaggcagggataggaagatagtcctagaaaccaatatacagcatactttgtggctaattcaaatatgatagttcaatattagttatagaaagaatttttttcactagaaagctgttagataaatttaactatttctgttttctggtatccatatttatctctcatgtgaaaggactacttggatttgtgcatcagattaatgtttcaaatcaattgaaacttttttcagttacctttgttctagaaaggcatgtagtatatgcaatagtattttgactattaattttttcagcaaacttttttcttattttattttaatactttatttttttatagtctagccatcgtccccttcccagtctacactcccatagttcctcatctcattcctcctccccagtctctaacagaatatcccacccccacccttcccaatcgctgccagacctccccactccctgggacctcaggtctctcaagggttagaggtgcatctactctcaatgaggccaaaccacgtagtcctctgctgtatatatttcagtgcctcagaccagctagcatatgctgcttggttggtggctcagtgtctgaaggatctcagaagtccagaatatttgagactactggtaatcaatgtgaaaaattatttcatcccagaaacatgtatagtttcataatggaatgccaaacaaattagtaaagtcctatgtaacatgaaataattttggaggcatgctgcatgttttcccagaatattatcattctattttctctacatgggggtctgaaacagatctatgagcctaaagacatgagatgcttatttctatccagaattaaaaggggaaagtgctgcacttggagatatgcagttagatgaacattggaaagttgtctttcataaaatttcagcacttttctttaaaaaaaaatagtgtcaaggacagagaagggaaaattacccctattctgcttctataagggtgttcctctccactacctactcattctcacctcacctccctagcattcctctacactggggcatcaagccttcacaggaccaagggccttccctcccattgatgccagataaggcctcttcagatccttcactccatcccctacctccttctttggggtccctgtgctcagtccaattgttggctttcagcattcacacaaaatcttcaggaactatacatttggaagtccttaagaacaaacactatcattgaaatgattcctgacattttaatttgcaggtgattttacaacttagttcttaacataccttaatcaattgtatattcgaatccatagccactatacctaaagatctccataccaagatccagatcagaaacttctatcacccagcctccagattagggtcattggtgagccttccaattctggattatagttcattccaaatatagtcaagttgacaaccaggaatagccactacaggcgactaggccatcttctgctacatatgcagctagaaacaaaagctctgtgggtactggttaattcacactgttgttcctcctatagggttgcagaccccttcatctccttgagtactttctctagctcctccattgggggccctgtgttccattcaatagatgactgtgagcatccacttctctatttgccaggcactggcatagtctcacaagagacagctatatcagagtcctgccagcaaaatcttgctgacatatgcagtagtgtctgggtttggtggctgtttatgggatggatccccgggtggggcagtctctggatgatccttcctttcttcacagcttcaaactttgtctctgtaactccctccatgggtattttcttccccattcaaaggaggaatgaagtattcacactttggtcttccttcttgaatttcatgtgttttgcaaattgtatcttgggtattcgaagtttctgggctaatatccacttatcagtgagtgcatatcatgtgagttcttttgtgactgggttacctcactcagaatatcctccagatccacccatttgcttaaaaatttcataaattcgttgtttttaatagctgagtagtactccattgtataaatgtaccacaatttctgtatccattcctctgttgaggaacatctgggttctttccagcttctggctattataaataaggctgctataaacatagtggagtaagtgtccttattccaagttggaacatcttctaggtatatgcccagtatgcccaggagaggtcttgctggaaactccagtagtattatgtccaattttcttttttaaggcattttattagatattttcttcatttacatttcaaatactatccccagagtcccctattccctcccccaccctgctccccaaaccacctattcccacgtcctggccccagcattcccctgtactgaggtagatgatcttcgtgaaaccaaaggcctctccgtgcattgatggccaactaggctatcctctgctacatatggaactagagacacagctctgggggttactggttgatttccagagtggttgtaccaacttgcaaccccaccagcaatggagaagtgttcctctttcaccacatcctctccattacctgctgtcacctgaatttttgatcttagccattctgactggtataaggtgaaatctcaggcttattttgattttcatttctctgatgattagggatattgaacattttttcaggtgcttctcagccatttggtattcctcagttgagaattctttgtttagctctgtaccccacttttaatggggttatttgattttctggagtccaacttctagagttatatgtatatattggatattattcccctatcagatttaggattggtgaagatcctttcccaatctgttggtggcctttttgtcttatagaaagtgtcttttgccttacaaaagctttcgattttatgaggtcccatttgttgattctcgatcttacagcacaagccattgctgttcggttcaagaatttttcccctgtgatcatatctttgaagcttttccccactttctcctctatacgttttagtgtctctggttttatatggagttccttgatccacttagacttgaactttgtaaaaggtgattagaagaccaaacctaaggataataggtagagatgagaatattttaatgtatataaataatcgcattagtccttttaggcttctataaatacagcacgaactaatttatttatgagcaacaaaaattgatttcatacagctttggaggtggaacgatgtgagagtaaagatgctggcagaattacagtcttacatgcttctacttacagagaatattttctcactctaacctagagactgccatatccagggatccaccccataatcagcatccaaacgctgacaccattgcatacactagcaagattttatcgaaaggacccagatgtagctgtctcttgtgagactatgctggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaacagatggcctagtcggccatcactggaaagagaggcccattggacacgcaaaacttatatgccccagtacaggggaacgccagggccaaaacgggggagtgggtgggtaggggagtgggggtgggtgggtatgggggacttttggtatagcattggaaatgtaaatgagctaaatacctaataaaaaattaaaaaaaaatgtgaagtgtttcttgtatttctctttgctttttgataccagaccttaatatgctgcacaagttgaacatcttagtacttttctattatgaagagacaacatggctaaggcaacttatgaaagaaatagtttattgagggcttacaaatttagatgttgattccattaccatcatggtgggaagcatggtattgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgggaatggtctagatatttgaaacctcaaagtccattcccagtggcacacagaattcaacaaggccacatgttaatccttctcaaacagttccaccaactatggatcaagcattcaaattttataaaagcgtataggaggcattctctttcaaacaatcacactgagtataaaaagtttgctttctctttcattcttatttatgtatttttatttattaattcttctctcatatgttgtatcctgaccacattttctcctccctcctctcattccagttgttcctgcaccatctgccctttccgtatccaccccacctccatttacatttagaaaatggtagacctcccaggaatatcaatcaaaaatgacaaaacaaattgtagtaagattaggcacaattcctcatattaaggcaggacaaatcaacccattaagaggaagaatctcagaagcagtcaaaagagtcagagacagcccctacttacattgttagatgtcacacaagaacatcaaactacacaaccataacagatatgcagaggacctaggttaaacccacactagatccgtagttatggttcagtttctgagaaccccaatgtgctccagttagttgattctgttggttttcttggggtgctcttcatgcctctgggtcctacaaacatttttttttcctctcctcagcaggattacccaaggttggtttaatgtttggctgcgggtttctggatcttctcttgtcagttgctagatgaagtatttatgatgacaattatgctaagctctagtctacaaatatagcagagtatcattaggaattattttattgtctcctatttttgctaatcatattcagttctatcctaggtctctgaactatttagcctctggttccaggccctccaggaactgttagacatgggctctctctcatggctgggtctcaagctggaccaatcattggttagccagtcctacaatttctatgctacctttaccccaggacaaatcagagttttgggggctgggttggtaccctaatccctccactgaaagccttccctggttacaggagataaatgtttcaggttccacatcccccattattaggatgcttagccatgaaatctattctatttctcctttccaaggagattcatgtgttctatctcaccttgagccttccttgttatttagcctctctgggactgtatcacgagtatgcttttttttttttaattagatattttctttattttcatttcaaatgttttcccctccaacccaccccatgctccctcccctactcaccaacacacccacactcacttcctggccctggcattcccctgtactggggcataggaccctcacaggaccaagggctctcctcccattgatgatcgactaggacatcctctgtgacatatgcagctagagccataagtcccaccatgtgtactctttgattggtggtttagttcctgggagatctgggggtgctggttggttcatattgttgttcctcctatggggctgcaaaccccttcagctccttgggtaatttctctagttcctccattggagaccctgtgctcaatccaaaggttggtcatgagcatctgcctctgtatttgtcaggctctggcagagcctctcaggagacaactatattaggctcatgtcagcaagtacttctcagcatccacagtagtgtctgggtttgttgactgtatatgggatggatccctagatgggacagtcactgggtgacctttccttcagtttctgcttgaaactttgtcgctgcatttcatttagatagggacatttctgggttaaaaatttggaaatgtgtgagtggcccaatcccccaactggtggcattgcctaacctctagatatggtctctacaggatctccctgccctttgttgggcatttcagctaatctcatcctctttgggtcctggtagcctcttgctttcctggtatctgggactttctagtggctacccacagtttgccataccccattgctacacactgctgttcaattttctgtccctctgtatatcatcccggtctactcccatacctgatctttcccccttttcccctccacatcctctcttctgccaaagtcccttccaccctcaaactcctgtgagtataatgctcccccttctatgaaggactgaagcatccacactttgctcttccttcttcttgagcttcacatgatctgtgagttgcatcatggttaccctgagcattttgcctaatatccatttatcaatgagtacataccatgtgtgttattttgtgattgggttaccttactcaggatgatattttctaggctcatccttttgcttgtgaatttcatgaagtcattgtttctaatagctgagtaatattccattacataaatataccacattttctgtattcattcctctgttgaaggacatctgcattctttccagcttctggctattataaataaggctgctatgaacataatggagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctctctctctctctctctctccctctttcttgctttcttgctttcttcctttctttaattccttgtttttatttaatcattttttacactccttattttattctcctcctggtccaccctccaactattccacattccatacctcctcccaaaccctgtctccacaagaatggccctgtcccccacacccacccctctagacaaaccccctggggcctccagtctcttgagggttacatgcatcttctctgactgaacccacacccagcaattctctgctgtatatgtgttgagctggtgaatgctgcctgcttggtgattcagtgtctgagagatcttgtgggtctgggttaattgatacttctggtcctcctacagggttaccctcctcctcagcttcttccagatcttccttccctacttcaaccacaggggtcagcagttcctgtccattggttgagtgaaaatatctgcatgtgactctttcagctgcttgttgggtcttttggagggcagtcatgataggttcctttttgtgagcactcaataacctcagtaataatgtcaagctttgaggcctccccttgagctggatcccactttgggcctgttgctggaccttcttttcctcagggttctctccctttcctggattatttagtttttttgatatgcagtctcttgactttttcatgtattttagatattggcccttgtcagatgcgtaggtggtgaaaatctttttccattttgtaggatactactttgtctaatggatggtatcttttgccttacagatgtttttcagtttcatgaggttccatttattaattgtctatcttaatgcctgggctattgaatgatgttctactcagaaagttgcctcctgctccactgtgttcaaggtttatatctcactttctcttctatcaaatgtagtgtatctggttttatgttgaggtctttcatttacttggactcatgttttgtgcagaatgatgaatattgatgtatatgcattcttctgtatgccaacatccagtttgatcagcagcaccatgtgctagaaatgctgagaattctccagggaatatttctacattctttatcacaaaccagatttttatatgtgtatatattaatgtctgagactataactcaattccatttaccaatctgtctgtttttataccattatcacctggcttttattactgttgatcagtaggtagtagagcctgaaatcagaggtagtgatatttccagaagttctttcattgttcaagcttgtttttataagatatttataagataagaatattgcttttataagatggccattttcactatgttaatcctacctacctatgagcatgggagatctttccatcttctgttaccttcttcagtttctttcttcaaataattgaaattcttctcatctaggtcttgctcttgcttggttagtttctgaataatattttatattatttatgccttcttgtaagagtgttgcttacctgtttttttttcttagcccattttttatgtgtatttaggagagctactgatttttaaactaatcttttatccatatactttgctgaaggtgtttattagctgtaagtgttccctggttgaatttggggcatcagttatgtatactctcatatcatctgtgaacaaaattacttttttttccttttcacaaatgtcatgtaattatatgattgctcttgctagaacttcaaatactatataaaacttttactttcttttataagcatctagaggggaagggttgcatgcttagcttcaggttttcattttatatgatattaatcagatgacctaatcactactgtcaatcccagttttctattattcatcattattttaggaatgaggatttggacataatgaaattaagactgggcaaaaacacccaaagcacatagatgaactatatagtaaatattaatttgttcacattaattgggagagagtttttaaatttcggggaagaattaatactagttactatgatgttgcatggtttaatattttgctttcaaatttcagcatgatttagtattttgttttcaaattacagtgttatcttcagttaatagatgcagaagccttcctttagtgagacttcttgtttcataaatattttagtataaacattgaaatattgttgactttagtaagtagattcttatttttttctaaaggaatattgaacttttaataaaacaaagaaaatcatagagatcccttaatttttattacttaaataaagcatttttaatcatgtttgtattatcaaatcctaatagaaattgcactaacttatgccattttagacaaaaataaccagaatcacaagtataacaaattaactactgatattttctgatgaataatctatttcataattcaaagaaaatatttcctctagaaataaatgactagagcggtcgccatcttggtccgggacctgccgaacttaggaaattagtctgaacaggtgagagggtgcgccagagaacctgacagcttctggaacaggcagaagcacagaggcgctgaggcagcaccctgtgtgggccggggacagccagccactgtctggaccggaggacaggtgcccacccagctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccagctggggaggcgacctaagccacagcagcagcggtcgccatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtccggaccggaggacaggtgcccgcccggctggggaggctgcctaagccacagcagcagcggtcgccatcttggtcccagacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaagaactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactagcagatttagatactcaacttttatgcttcttaaaaaaatttttagccaccaaattgaattttgactttaaaaatgttaagaatacattggacttatttaatagttgaatcatctattaaaaatctgctcccatttttagtgtctgcatagtggtagaaatataatacaagtaagtggaaacattagattgtaacctttaagtaaactactatttcttgtaatttacttggagctaatgcatgtggatgttagatttgccttcagcatcttttttatatctatttgaaaagatatgacatatgtcagtgatatttatttaaaatagttcaatgtgattatacctaattaaattacataaaatgaaaaaactcaatttaagcaatattcagtacaaaactaaaacatacaaaaaagtaacaaaaataacttttgagggtcagacagccctgcccttgaatttttcaagaaactccaatcattgtcagccaaaactcaaggtgttaattaatgtgatagaaaaaataagccctttcaaactttactttgactagttatgtatttattatgagttctaagattcttctctttagtctcatacaagtgtctcaagtttataaaatttctccaaatgttaaggataagacatatgtactgttcgttgtaatttttttcaatgactttagagatagaatatggggtttcatgtatgctgaacaaatagaccactactgaaatacaccatgaactcttggctgtaatttttgctaactctatttcattgtgcttttgtctccaaaatttatttattcttattttatttattgtagtttaaaacatgaaaacatttctttatgttatataaccataaaaatatgactattctagtgacactgaggttcagaagaattataatagaattatttttaggtcaatgatattatggacatttcttgcttactttatcctttaagttggtgagggttttaagtggagataagggtcagaccatttttcagactcttccagatccttactggtaatgggatataatgaatagacagaatgccgtggattattcatatccgtcaatctcttctataaatagttggttgctatacaatgcccattcataatgacagcaccagcaggattcctaagtcttcatgaattctcatgcactgaaaacagaattatacatgatggagataatttcttaaatgacttttcaatgataaaactgaacataaaccactcatccttttttcttggtgtatctccaagagaaacagatgagatgtttctaagaatatttatagaaatagaaatttatagacactagttgtcatagctacaaactgaaaactcctaaagatcaatcaatactagcaaggatagttagaattgtcagaataacctatatccaaaattgagtgaattcttcttatggtcattaatagtattaatgaatctcaaaaacatagtattttgcaaattaggccagaaaaaaatatgtttcctttatgctaatattaaaaagagtaaaaataatcaatagtattagaaatcaagttagaaattgcccttccttggggagaaataattgaaaagagccattggaaacaagtctggatgtcaatatattaattctgtattaatctgtttctgggttattagcttatgctcaattttaaaagttcattgatatataggcatagtctatttcagtaagaaattataatctttgtaaagttttgaggttaaatagaataaactgaactcatgtggtaatttttgttagtgttagattccttttgttgttgcaacaaatcaggacaaattggatgccatgatacaactgcatataaatattttctctgacagatatgaaggtaagaaatctaaattcatgttttatgggtttcttttgttgcacaggctacaaatgtatctatttgatgcctctcctctcataatatcttctggtttctcccagttatcttgttgttcatggactaacagacatatcactccaatctctgcttccttgttcacataatgtattcctttgtttcttctcttctgtctttgatcaggataccaactgttaaaatagggcccatatggatagttgaagttcttttgtgttaacttaattacatcgataacagagctttttccccttaaatagccaagtcaaagattcccagataacatacttaattttggttggataccattaaattcactacagggctcattcctcaaagtcaacatgaatcatagtaatggagacacagcaatattatttatgtaatatgatacaagtactaaaaatcagacaaaaatcttcagaattttcaaagatagagagtaaattttgatattatagtgaaatgcaataagtcacttaggttactataaatagaaattccaaaaaaataggatttgaagaaaaatggtacttctgtgtcaattgataaagatgaaacttaaaatagtaagaatagttaaaagttgaaggtgaccaagtagggtacacagaagggtttggaaggaagaaagggaatgatgaaatatcatgttataatctcaaattttaaaattcaaattataaaatataaaagaaatcaaaggactaaatcagtcttcagttcaatcattcaggtagtattatatcactctataatataaaagaaagaaaagaaatttacaacattaccaaaagggaacacatgtgaatagataaatgaaaaatcaatgggtttctggaactgtggacataaagaatttagagaaaaggtgagtcattctacataaacaaagaactatgaatcagattgtagtttcatttgtgtacattcaaaccaccactacatttcgctcatgtcctggttcactggcgcttgagctggtgatgcattattctgaagactggatgattattctctatagaacattcctaagcttaatcagaaatttctgggttttggtgtctatgttgttgttggtataatacctgtcctttccattgaaaagattgatacgttcctaacatacacacacacacacacacatgcacaaacacacattaaaatctatctgacaactatcctatctatttaaagacttattaaattgtgtgatacttcacttatatcagatatgaaaacaaataaatttttaagaagctaacagataaaagaaacaatgaaaacacaaagattatacaggataataagcttcaaaattaatgactgtacttgactacactcagaactattttataaaaaattgtctaaatatgaaccttcatagaattaataagaacactagagagcttaaaatgctgtggtagcttaaatgagaataatgcctaaggactcttatgtttgaacagttggttcccagtgagtggaactgttaggtagtgtaagattgttggaggatgtgtgatcatggttttgaggtttcaaaagccaaagccattcccttttagcacttcctgtctcctacttgtgaatcaaaacatagctctcagctactgctccagcaccaggcctctctgcctgctaccatgttccaaaccatgattgtcatggacccattcagacaaaacataagcaacaagaactctttctttttgtatgttgccttgtctatataatcttatcacagcaataaaaatgtaacaatggcttaggaagtgttggtatatgtctttaatctcatcactcagaaggcaaaggcagagggaggctgaactctgtatgatcaatgcatgcctagtctatagagtgnnnnnnnnnnnnnnnnnnnnagagagagagagagagagagagagagaagaagagaagagaagagaagagaagagaagagaagagaagagaagagaagagaagagaagagaagagaaaagaaaaagagggaaacaatcacaagaaagacaaataacataccacaaatctcacaaaagcaaaaacaaatcatcaaagagattagaatttgtttgacaggaaaatcaatacagaagttctaattaaaaggaattttgaagaggtgaaaaatatagatgagaaattttcagataaataactatccttaattgataagtgaagtttttatattctaggatgcaaaaactaattggcaaagtaaattatggcaacacatactgactcatattttccagaaattttagaattagtataaagattctaaaagatttctaaactgaagtagaaaaaacaaatgcaaatgtgatgtaagtcagaataccttttgatatcatcaaatgcaagacttcagaaatattaaatatcaatttgtgaaggaaatatactattttcctcttataattatatatcctcttagattaaaatcagttcataaacaagagtaaagttgtcaagactgtgaagttcattttcacacaaagtcccagtaattttgttaagtaaactgacaaacaagcaataagaacctgatatcaggatcataggaatttttaaagtaattaaagagaaaatggaaaacaaggattttaatactaataaaaacatagaaaagaaaactgaatcagtaaaattattttcaatgaagaaattagtagaaaatggtatactaatcagaataatatatttaaaaactaaggcccttcaaagtctttaaaaatcttgacatatttatggctgctagagaattcttcatatgataagccctttctctatacttgtcatcatgcactagtctttcaaagaccaaaattaaatagcacaaacaacaaaagcagtcatacatacaaaaaaacaaaggattaaaccacattatactttgaactcttatacagaaaatatatttaattaaaatcatacacctaattgggtgttaaacatcagaatgcaaagcttcatttccacctgatagattaacagaaaataatatataatattgacaattggaatgtaggatatgaatataggttaagaagacttgttctcatagcaatgttatacctctttaaaaaataattctaaagaaatttgagcaatttttaatttggtatatctgaacttgtggaggtatatgggtattttaaatactatccttttatgttggatgatttttatttcctgaactataactgaaattaccattcatacccaaaatctgccttgtgtcttttctgtattccttcatcattgtacctttgctttaaaatttatgctggacttaaaaaaaaacctattgaaagaagtgtcatattcatttttgtaaatctggaccacatatctagtgcatagtaaacacccaatatgattttattaagctgattccaaacaatgatcttacacagaaacatttgtgtggtggtttgaatgcgaaatgttcccccattggctcctgcacttaagcacagtgttcccagttagtggacctgcttggaggaagataatgaaactctaatgataagatccttgctggtgggagtggatcattatgggtgggactttggcagttatagacttgcccagtatccagttggttttctctgcttcttttatatggttgacataggatttctcagctctctgctctgactgcctgttgtcttgagttccttccattgtgggtcatccacacaagcacttccaaagttgcctttggtcatgatactttattaaagcaataaaataaataatacacagttgcctgttttaaggtaaatttagagaaaaacttaagtttaaattatttatgcttcctggaatgcaagtttaagaaaattaaatgcaatgttttatgtttgcatagtactttgttcattgaagatgttccagactctaaattagcaaaccannnnnnnnnnnnnnnnnnnnaaaaggccctctttcaatttatacactcataaatatttattccttgtaataatgctgagttctagactgctgaatgaactgtggcacttttctgtaactctgttgtgtcctgttggctctatttgccattctagtaatgttaacttttgcctgtcaacagcattttttttaaatatctagtgggtacatagcagaatttccattaccttctgctcaattagagtctggtcattaagcaaagcttaaagacaatatgtcatttgtttggaagttgcattattattattattctttcttcatggcttcagttttctactctcattaataaaacatatgctatatttttgtacttaatgagggttttttttcagttgaacaatactcaactctgaaattagtctttttacaaattcatatggtggctctataggcccatgtgtgagtttatttggcccccatatgaattaatgtgctgggttatattttatcaaatgaattgttagtcaaagggacatcaaatctacttgttcatatatacacatgatgccaatttgtagttttatggctagtttttgaaaaaaaatgtatttttatctgctacctatatgaaaaggatacttttacttctgaaaatgaaatgaagttctttataatggttttccattttgaaaattatttttgattgtttgcagtattctctgctttttcagactttgggcagacatgtggagttgccaagattgctattgaacatttgaaaagaaaagtgtattttctttcattttttctttttctttttttaaaatataatttacaggcatgcatgtgcctctctctgtctctgtctctgtctctgtgtctctgtccctgcctctgtctctgtctctgtgtctctgtctctgcctctgtctctgtctctctgtctctctctgtctctgtctctgtctctgtctctctctctctctctctctctctctctctctctgtgtgtgtgtgtgtgtgtgtgtgtgcgtatgtgttgtttgtttgtttatgcctcagcatgcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgatctccagtccagctaatcaatgaagagtaaattaagctgataaagcatcagtgtgggtacagctggtgtgatgaaggttggcgctatgctaccagataacacaggcaatatttttattcacgtggagtgctgccttgctatgcatttcaactgttgtcagaatgatcgattcttatatctatatctatctatatctatctatatctatctatctatacatacatatacacacatacacacacacacacacacacacacacacacatatatatatatatgtatacatatatacatacacacacacacacacacacacacacatatatgtaatgataagatctaactactttgggtgtttacccaggggaatcacagctgcctggcaaatgcagtgtggcggctaagcaataatggctgctatttctctgatttgtttgtggctttgtcagcatttgagtaggggaagtttaagcacagactggggcccacactcatccatgatctcatccagtcaatggctttaaatattctctgcaatgtgaatgactcccaaatttatatctctggtcctgatgtcattgctgcatcccaggctcatatatacagctacttactagagagctctgctttactatctgtgagatatatccagtttaacattagtaaaaccaaactcttcatcttcccaaccatataagcctctgattgccagtctagccatcttgccatcacagtaaatggcaacttatttactgtgatggatccaacccaagctttatagttatccttaattcctactttaccttgtagctcacatttcaaggacattaccttgaaaatgcatttactacctagttgcttttctgtgatgctacctgaaacctatccaaatgccaattaattatgtctcaactattttctccaaatatgacaacttgcttcttttctccccatactatactttcactatactttgttttagcaattgtaccatcaaacccacagcaaacactagcataaattatatcacattgtcatctgtgtgtaagtggttagagactttcaatggtaaagtccataccacacctaacaagccataagcaatccgtgtctttgaatttttcctaattttgtcttccttgtacttcccttagttcatgacttctgctctcactactaactctgctggttactatcagttctctagtactgagaacagtgcactgtgcacagaagttcccagaagtatttgtagaaagtgtaaacatttacttgattcttcttttcatcagttctaaaatagtgcttaggatagctgaattgtttttttgtatttttatgattgctctgtgatatctttagttcttcaatggaaaagtatctgaaaaatctgctcttaatgctgctcatttcttcttctctaactagagtagtcatgattcttgcaattgaaaggtaggtcttagggtactttccactctttggatggctgcccaacaaacagttcccctttcctattctgctctgtctgattatttcaaagatgagtgaaacagcttactcttctttggtctaatatttccaacaatcactgtattatcaaatgagtttttaaaggttaaattctttttctcctttagaaaggatctcactatagagccttgtatggccaggatcttagtaagtagaccaggctgacctaaacccactgacatctacctgcttctccctcccagtggtgggattagaggcataagctaccatactcagcctgagaagttgtatgcttttttctaatgttgccaatgagctttctgccgtttttcaaaatagcaaccaccgaatccgatattaatgtttgctatgacactctgaaaaagctttgcctctgctacttcataacatctatttctttggggttttgctttttccaattctaatttatattaaattatatgtcatttaaattagaaatacaaatctgattgacaactgattttcagtaggacaagctggtacactttgatgacatcattgaattggatatccatgaagatacagcttcctgtcttacatgcattagcacacaattgtattcccccaaaattttaattatgttaagatgattatttcctctaagctctcaagtatagccagaggtctgaaactaatcacctgtcaccacaagactgcccaacccaaggtgccctacaagtattttaatttatagtatataccatggcaaatattaacaataactctggtcacgtacagctaaataaaactcattctgcaatcatggaaatgttctaggtgtccttttcaagaatgtatccactagaaatatgtgattcctgtgttttttcattgtagttagttttgctgagcctagtagcaatctgtatatataacctaccaggaactaaagatttatttctcctgtttcttttttttatcaaatattttctttatttacatctcaaatgctatcccgaaagtcccctataccctcctcctgccctgctcccctacccactcactcccactttttggccctgtcattccactgtactggggcatataaagtttgcaataccaaagggcctctcttctcaatgatggccaactaggccatcttctgctacatatggagctagagacgcgatctctggggatactggttagttcatattgttattcaacctatagggttgcagaatccttcagctccttgggtgctttctctagcttctccatttggggccctgtgttccatccaatagatgactgtgagcatccacttctgtatttgccaagcactggcatagcctcatatgagacagctatagcagggacccttcagcaaaatcttgctggcatatgcaatagtgtctaggtttggtggctaattatgggatggatccctgggtgggtagtctctggatagtctatcctttcgtcatagctccaagctctgtctctgtaactcctttcatgggtattttgttccctattctaaggaggaatgaagtatccacacgttggtcttccttcttcttgtgttttgcaaattgtatctcaggtattctaagtttctgggctaatatccacttatcagcgagtgcatatctaatgacttcttttgtgattgggttacctcattaaggttgatatcctccagatacatccatttgcccaagaatttcataaatacattggaaccaaagatttaaaataaggacaatttagcaacttattgagctcaggaaatattaatttgaggtgttaacaacccataatgggaccagcaggcaggaattaaattaaattgataggctactaacttgagaataaaatcatcaaaggaaacctcattttctaatgtggctgccattgttggatactagccggctgacactagctgtgttcccttgcccttctgttgtcttctttttgtttgataatatggcaacagtagtgctgttgtctggaagtgacttcaaagtcccacctgcaggcctttctttatttagtacacataatctggcactcatattgttcctctaatagagcctggagccatctagtaatttcccttttggtccaacagactatgtgttgtttactgcccaaatctctgtcttcaaggatctgacaatctgtgaggaggctagtgttctgtgttaagttattctgtcatgctagtttagtctttatggaattatcttttgcttgcagccattgtttttgaagcattgtctaatccaagtaagagcattatgtagtctaaagatttatgagtcaaaatttacaacctaatgtcactttacaaggagagaaagcatgttagacaagctattgttcatgcataaattaatcctaagagaaaataagtatttggcctctacctcatgatacttatgtctgttaattctcttaataaagtgtttgtggtgatacctattcactcatatttctcaagatgactctgatcaagtgtgtaccattgcctcattaacctttgcccatggcctctgctcagctcagtttatttattatgttgttcctttttctctataattacattcctcaccttttttctcaagataatttagcttggattctgaagaaattaaaatcccagacactaatattaatacactcctgtacttttggagcacattctgccatctaggtagaataccacttactgttacttggaatctcactcaaacttcagggcaagccttaaacatattattttcaagaggtatattttatattctctttcaaacaaggaaaccagaattataacagatgaataaagttgcctaaactaattctacaatgaaagaaagctaagaatagaattcaggggttcttaatcttagagtctttgttctttctacagcatacaaaggagattaagaggtctaatgaaggggtatagaaatcatcaaccttttgtctactctagatagctttgcggtttccctgcttaacctactggcttctaagtcttgactcctgcccattgtcatcttctgtcttacctgttgttttaatgttcagaaaacctgtatataagaaacaaatgaatggttgtatatttttacaatgtcagattttattgaataacaaaaaattcacaagtgggcagtggttttaattgtagcaaattgtcagactggcatctggctgaggctgatgcagattatttgatattccaatattaattactaatattaactctcattacatacacagtattatatatatatatatatatgtgtgtgtgtgtgtgtgtgtgtgtgtgtgtgtgtgtatacacatacatatatgggtgtgtgtgtgtgttcatttgtgtggtttagtgaatgatgaacactagttaaagatattataaaacaatttaagtgatttcagaactgagttgattgaaatgtatttctagtctatattgttaaaataaaaagctcaaagctatcttcatggaagaaactaatgctgagaccatggaagagtaagggttgagagctaagatgcagaattgagagcagcttccaggaaaaaggcagaagctggttgagacgagaagaacaagtctaattgggtgaacaggtaaaggggtaagctacatcaacagctggggatccaaccaagctgaagcaccagagacatgtccttgtctttcataccacacatgcatacatactcacatgcacacactggatatcagataaaaaatagtgatggagttgtgttattgtaatgttaggtgcctaccactttatggggtctagataagagaattacccctttttcagtttgctgcttttgataagtttggaggtagggttttcctgaattgagtttaatatgctcatgtatctctcaagtcatattttatactgtagagtataacattataggatgggacactttttactccaaggaatgtcacttattagtttgtgatttatgtgtggtcttagagagatggtgctctttgcctgtttacccaagagtgcaaacattttccatcatcaaaatgcagttgtttattaacctggtttctcagggtgaggcacagctgaaaagccactgtttaatgcagtatgtagtaactcagactatgtcactcactgagagcgatacttatctttccctaaggagactcaaaggatggtctgtttacccaagatggacaacaaagacagacttaagtaagatattatcgaaatccaatttagtggtacaaatagtttgtttagcattcctaccaaccatggataatgggttacttacagtagagtgagtaactccaaaacagcctatattcccattccattatggttaatgactttctagaaactaaatcataagcccaactttcaattaaccttttcttctcacataatatgacatcttccaagacaacttgctcctagggatggagtaatagatagttggaataacaggtaacattttcatgaccccatctaaggagtatcagtacctgacattgcctggctagcctgcattgtttggctctagttaccagagtaagatgacatcttgatagaagttagaaacttttaagaaaacactatcttatggtatatttttatacaagtagaaaactacttctctgtcaattatattaaacagtatatggtagattgagaaagtgccacagattcagatactatcacaaatgcctgttgaatctcctagtccaatcttattataagaggttaaactttaaagcaagtacaaatattatttgtcagtatttgacaagtaacctagtattctccctaaagtaacaaaccactcattaaattcataaatgcaatgagcactggtaggatacgttgtttaatttttttctatatttaggagaaaatgttacttttgaggaattgtgctaccctgtgatattgttcacagtatgcttctattattactgtgtaactattacaaacctattttaaaataatttggcctatgttcataaaagttgaagatcagtagaaagcaaggttatcaaggttcattctctttcgcagagcaatgtttctagaatgcttacctttcaaagaggacacatgataatgaaatgttcaaattatatgtcatgatcaagttctacagtcactaaaatgctctgattatggggctggagaaatggctctgctattaaagaggacttggttttgatacccaacacccacagtgtaccttacagtagtctgaaactcctattccagaggatctgaaacccacccaataaaaatatgtttaaaaaaatattctggggttgtggtggtgcactcatttaatcccagcactcacttgagagacagaggcaggcagatctctatgagttggagaccagcctgctggtctacaaggtgagttccaggaaacccagagctttacagagaatcaatctctctctctctctctctctctctctctctctctctctctctctccctctctctctctctctgtgtgtgtgtgtgtgcatgtgtgtattgtaattattttgacccaaaatagacaaaatcttgcatcttaatatttttaataaagaagaaccaattttcattttatatttgcataattattttaatggaaaacttgtaataatattgaagattatctctcacaccaaatttctttatattgctaaagataccacatatttgagtcacaaaatgtggagaaatttaagaggataatgacctgtatactacagctctactggcttcctatactaacttccatagtgtaaaaattgttgtgcatactatttttgtttttttggttacaaatatttttttttattctttaaactttctttacagtccagactttatctcctcctggtatgccatccaactcttccacatcgcacacctcccaccctgtctccaagaggatatccccaccaccaccccatcccaccaaacctccacactccctcaggccccaagactctagaggatgaagtgcatcttcattgagttagttcaaacctggcagtcctctgctgtatatgtgttgggggcctcatatctgctagtgtatgctgcttggttggtggtccagtgactgagagatcccgggggcccaggttagttgagactgctgatcctcctacagggttactctccttcttagcttcttccagattttccctaattcaaccacagggctccccagcttctgcccattggttggttataagtatctgcatattattctttctgctgcttttttgggtctttctgagggcagtcacgataggcccttgtttttaagcataccacagcatcatactcaaagttctagctagaccaataagacaacaaaaggagatcaagggtattcaattaacaaagaagaagtcaaggtatcactatttgcagataaaataatagtataaataagcgaccccaaaagttctaccagagaacttctacagcttatacacaacttcagcaaagtgcctggatataaagttaactcaaataaagcagtagcttttttttttatacaaatgataaacaggctgagagagaaattagggaagtagcacccttcacaatagtcacaaataatataaaataccttggggtaactctaaccaaacaagtgaaagatctgtatgacaagaacttcaagcctctcaagaaagaaatcaaagaagatctcagaaaatggggagatttttcatcctcatggattggcaggattaacacagtaaaaatggccaccctaccaaaagcaatctacagattcaacgcaatccccatcaaaatcccaacacaattccctaaagttatagaaagaacaattctcaaattcatctaaaaaaagtaaaaaatcccaggaatagtgaaaacaattcttaacaataaaagaacctnnnnnnnnnnnnnnnnnnnnctctggggtaattaccatccctgacctcaattttcttattagttcaaaccctgcataacattttcacactttgtctagttctaaacaattttactagatttaaattaaattttcaatccctgtttctaaacttcataaacttcttctatcagtattcttcaaagtagattccaaaaattccagcaaaatcagaaggttaagaaaaactacaagggacaacataaattctgaaaagctattgctagcatggaaaatatgtgactagtaaaaccagaagatttatgtttctatccttactttttctcactgacaaattttggacattcctggaaaagtttcttactatgtcccttcagagaaaactggtagatgaaataaggtaactccataccctaaaacatgatgtgttatttttgtgtgtatatatgtatttccaatcttacatttacattttagggtcttataaggattgaatttattctgagaggtccagccaacataagtttacttaaatttgtcaatgaaattaagcaaaggaggctatatccatatataatcatacactgaggtggcacatatcttactttaaaataatccctagccagatccattgaatgtatattgtcaatcattaaacacataaatttaagctaaacactttgtaagtaagttttttctttgcaaataggttctctcactattaaagtataatttatcaagatttttttctttaaaataattttatagtatttcaactgtttaaaggtttttttattattatagtaattgggaggaaaaattaagggaaccagaggggtcaaggttaccacaagaaaacctacagacacaactaacctggacccattaacttggaggctcacagagactgaactgccaaccagagagcatacaggggctggatctagactccctacatatatgtagcagatgtacagctttgtattaatgtgggacacctaacagcaggagtaggagtctgactctgaatctgttgcctgcttttggatccctttaccctaactaggctgccttgtccaatctcaataagagaagatgaacctagtcagtattactgccacttgatatgctaaacctggtgatatatatgggaggcctccccttttctagggagaagggaaagaactgggaggagaggacagagaaaagctgtgattagggtgtaaaggaaataaataacttagtcgataaaaataattataacagttatttctaaagtttcggaacaagtattactctgtatttgaaggcttatttgatggcttaagggggtcttctcgattttagtttattgggtgtgggaaagaggcctttgcagtgattactactttatgaggtttcaagataggatagtagattactcactctttatttgacttattaactaattcatcctacttttgtttttcatgtatccactgcatacttactaaactttacctttttgcatgctgagcctatgaagggttttagagatgattcctgactgtgacctactccgagagcccaggctgagtcttcagatgccttgtgttttcagtctgtgtcgtcagtcgatttctgtctcccagataattgtaatctttgtataatttgggcttgaaatgtaggtaataacaccattttcaataaatagttatcagacattatttttaatcttaaaagaataaaacacctggaggaggagttcctaaaagttctaagctatttggcaacaaaagtcaaaatatacttcctactactcataacaaccctacttgaaaacatagggtcacacacgttagtataaaaaacctcaagaaatgtaacattctgcagaaatatagctataaataaaccaactcagtataatctggaaggtcactaaattgcactatgttatgctatggagctataatgttttatggtgttatgccatgaaaagaaaataattttaaatgtattgattcttattggtagcatgatgccattcatctgatctacaatttactttcaataacatttcaaaaatgtgtttattaatttttatatgaaatcatttacatatcaataaaaaataatatactataataatttttgcatacttccaccttgctacagaagattggagaacatataatttttttggaattattcattgtgccagaaagctgattagtaaccatcaggatttgctgtgtgtgtgtgtgtgtgtgtgtgtgcttgttttctattttcctgtcaacagaagtgaaaacaataattggcatgctcaccttcttgattatagctgttatatcaatcagcatcctttttctaggttttatcataatttcactagccatgcattgttttctttttctcaccattttaaactttatctctgagtacacacatcaatttactttaaatgcttaaaatcagatatgcaatcagttagaattcatcctaactgcattcatggaaaatctgcactgagatttttaagagttttaagaatgaagtttaaaacattgaaacaatttatttactctacatctacccatgatgtctgctatttaacctccatgcttctctctctctctctctctctctctctctctctctctctctctctctctctctctctctctctccctcccatattttttgttcattggccaaaattggggtttagcagatatttgaatgatctgtgagatttgccatgcatctaggttagtctagcaggaacatacacaatagaagctagactttaagatagaaatatatatgtgaaaaatagagaataacaaatgaatgtgaaatcagccttgaataagaaactgaaaaggataaatttctcagttttaagggaccaaaatgacttacccatatataactcatttttgaaatagaaaatagtgataaataatgaaattggtttccataggtaaggtgactgaactcatttttttaaaaaaaaatttcttcaacacgggaactatggctcaatactgaagagcactcactgtgccagtgtgaggaatggagttcagatcccagcacccacataaattctggctatggtcccacatatattgtaatccaaccactgagagagacagagaaaggaagaatgctgagctttgttggctgctaggatcacagaaacaaataaacaaacaaacaaacaaacaaaaacacaaaacctgggttccagattcatgaagacacctcgtctcaaagggaacaagaagtagatgacagaagaggacacccaacacttctccggcatccatgagcataggcatactattgacacaacatgtatacatacacccatagacacagaagtatccttttatatctaatccttataaacataactttagtatatttttaattaggtattttcttttttttttttttttttttccattttttattaggtatttagctcatttacatttccaatgctataccaaaagtcccccttacccacccacccccactcccctacccacccactccccccctttggccctggtgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggaatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaattccaccaacaatggaggagtgttcctctttctccacatcctcgccagcatctgctgtcacctgaatttttgatcttagccattctcactggtgtgaggtggaatctcagggttgttttgatttgcatttccctgatgatatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagtaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggtattttcttttatatatattttattaggtatttttctcatttacatttccaatgctatcccaaaagttccccataaactcccccccatacccacccactcccactttttggccctggcgtttccctgtactggggcatataaagtttgtgtgtccaatgggcctctctttccagtgatggccgactaggccatcttttgatacatatgcagctagagtcaagagctccgggtggtactggttagttcatattgttgttccacctatagggttgcagatccctttacctcctagattactttctctagctcctccattgggagccctgtgatccatccaatagctgactgtgagcatccccttctgtgtttgctaggccccggcatagtctcacaagagacagctatatcagggtcctttcaacaaaaatcttgctagtgtatgcaatggtgtcagcgttaggaggctgattatgggatggatccctggatatggcagtctctagatggtccctccttttgtctcagctccaaactttgtctctgtaactccttccaggggtgttttgtttccaattctaagaagggacaaagtgtccacactttggtcttcgttcttcttgagtttcatgtgttttgcaaattgtatcttatatcttgggtattctaagtttatgggatatatccacttatcagtgaatacatatcatttgagttcttttgtgattaactttagtgtatcttttatatcattagatgacatggtagttacatatttgctcaggctcataactggagaatctttgttgactcatggacatttatttgcatcacatatttgatgtatctgtaaattgtctattgaaatctaccaaataggtacttaaaggggaaaaaacacctttctatttttgccaccactgtcattgctcttttgtttgtttgtttgtttgtttgtttgtttgtttgtttttgtttttcgagacagggtttctctgtgtagccctggctgtcctggaactcactttgtagaccaggttggcgttgaactcagaaatctgcctgcctctgcctcctgagtgttggaaattaaaggcttgtgccaccatgcccagctctgtcattgctcttttagactgcttatacatcctgctgcttgcctggctacctgactccctgcttggctctctgattttcatttacctcaatcctgctagactcaaacatcaagatgccagagctttggtacttcaatgtcaacagagtcactcaccttcacaaaaccctcaaaaccattcctacaatgtttagaataaaaatcaaatccttcttgtttttttttttttctttaaaagccctgcctgtattggttcatgactacctctaatcatctttaaaaatctgttcttacttgaatacaattatgataaccttctttaacagtcatcaaatttgtcatgtggattcctgtcttggtcttagcttgctcctccagatatacaaaaagttcattctctcccttcccagacctctgtcttaaatgatctttattcaaaacactcttttctgatagttgtccaaaatagcacccatgttactttctatctttttacctgcatcatttttatgatacttcttaacatctgcattgcactggctatgtattggtgtttattttatacgtttggttttacaaatatttgttccctgaaagcaggaatcttgtctgtctctgccctagtaaatagagcaaagaagaggtgcttaagaaagacttgctgaactttatatgccccagtacaggggaacgccagggccaaaaagtgggagtgggtgggtaggggattggcggggttggtatgggggacttttgggatagcattggaaatgtaaatgaggaaaatacctaattaaaaaaaaagaaagacttgctgattgagtgaatgcatgctagtttatttttattgtaaacaaacttatcaaactcagtgtaataattagaatccagttgataagatagattccttggttttaattaacacatatgttttgggtaaatacattattaatgttatttgacacaactcttattacaatgttgctatataggtgttgtttgtgtactctgctctccctggacttctgtattcaatagcttttctgttcttttatccttgaggcttctgaggctccatagctactgtgagtcaccaccattatcaatttaacaaaaaggagagattataccaaattcagaatattagagttgaatgacaaaatgctgtttctcttctacatgtagttcccatgtactatgttgatgtcctcttatgtccatccatttcttttccactctacagattccttacaatctatgttccatcattagaaatgataatttaaccaatccaggccaaagaaaacagagttgaaatcctacctgattcattaagacctcaagctctataggtgacccaatttttcttatttgctaggaaaagtaaagcagctatttgtccattcctttaggtttaaaataattcatgcaaaaatgatccactgtaaaatgtggtcagtgtaattgtctcagatgtatttacctatctatgaataattttgttaccagttttagatgatgaacctaaaatgaatctatagagaaattatccaaataacagacttaacacagtgtaccaaaaataagcattcttatgtataactctaaacctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcaattcatgattgctttggttgtacagtaagcaccagggatcttccctatccctgccttcccgtcactggtttggcaagcacattctttgcccccagttttttacataggggctagcgatccaaacaggggtacttatacttgggcagctagcactttcccaactgaattgtctcccttcatctcttttattttgaatttaatacttattattttaataaatttatagaaatactcatcaaattgaattatggataagaatacatgggttgtagaaactccaatttttgaagttaatagtttaaaattgagtcattttataatcataggacattgtgaaacatatttaatgcattcagaatttgtttgttgattgaattcttagagataaatcatttacccctttctaaaaaatactgtgtgaagtataactaatttttagttcagagtctaaagcactttgtacccttagttagatattaacttatcatttcacaaataatataattctaagtgctattgttccaaacataaataagtacttttacaacttacttattttgtatagactctacatagttatttaatatattgttattgtattttcacataaaccaatgtggggtgtttagtcatgtcatacttcacatataagatgactgcatccacactatgtttatttatccaacttatcaaagcaataagcagaattaggaattgttaagtgtatgattttccctactctaccaacatacttctaggtaacaaagtagaaaagaaactaactaaaatgcattatagaagttatttaggattattttgtcataggatacaagaatcattaagtattcttggtaatattttagaaactatagatgcaattattacacagagaaaagggtgtttatgctagataatttgcatttccatcttctgtaagaactgcagaaagaaccaagaatcctggatatgctactctggtttttggcttctatatgtaaggagaaaggattcaagttttcactgccctataactcaaatgtagaggaagtgaacaaatcagaaagctctgaattgctaagaatggtgccccaatcctttaatcccagtctgatctatgaagtaagtttcaagacaaccaggactgttacacagataaaccttatcctgaagaaaagaagaagaaaaacactgaataaaggaataataacagagataagcaactaattctgtacacatttcttaagttattgacttttaaatgttttttctaactgatgttcaacaagcaaatggaattactttaaattctacattttcacaaaccattttgttaactgagacacattagtgcaagaggtctattatcattttaatggctatattagctttaatgtacttgatacaatattctaaagaataaaatgaatgcctgaaaataattttgttggaggatacaaagttctatataatgcaaagctcatgaaagaaacagttctattataattgtgctttggatagataaaacatgattatgatttaaaatcacattgtgtttcatatcactactgttggatttggtcttgttttcctgttcctgagtgagttttatgtgtttttatatatgtaagaaaaagtatcccccagatgtgttattttcttgacagtaaaaaaatggctgctgtttttccttgtgagtaattgtttcagagctagatcaaattctagctttgcaaatacagagaataaatgcttctctaggagtttatttttgctggccattagaactcctgccgttttgcaacttctgtcatttgtcaattcatttcaactacgctgatatgcattaagcatcataatgtgccaaaaaacattcaaataacatgccagtgagtgaacattcttcatttgcaaaaatgaattttgtaagactcaaaatactgggaaattgagattcatcctaaccttagtgattacctcctgctcacaggctttttgctcttgggtcagatcagctgcttaactgttgtgctatctggaaactttgattcacttttaccaaagaaaaataaatcagaagagaaatgtttcaaactgatatccgtcataacaccaacatgtgacaattttagatttagattgcactgcaacagctcgctgctctgtgttgtgatgatttaattgcaagttttcactgtttagcagattgcacacaccttgaggggagactgcctgacagacttttcaaagggcacataaaaaaagtgttgagtggaaaggatctgctgaaattctactttgagattgttttattttcattgtcaaagcattgggcctctttgcatatcagattcttggacttcagaacacaggagttgaattagtcccaagatgttttattactaaactgcagatcaatgtgacttacagtgaattctgtaaaattccaaacaatgacagtgtttgacaagttactaatcacacacacacacacacacacacacacacacacacacacacacacacacacatgtatttcaagtcaaaaccttggaatgacaggctggctatgattaaaacaaaaaacatatattcaccagactgttgataagacaaacctttatactctgttgataagggcataaattagtagtgtagacattataaaataacaatttggaggttgcttaaagaactgaaaatacagctgccattttctccagctacatcgggtgtgacatacacttgtttttattatggcattattattcacaatatgcacaatataaaaccaaacttgctgctcattaatagaaaagtgtttaaagaaaatatgatagaagcacaacggatttaaaaaaaacatgaaataatgtcactttcaagaaactacatggatctggaaatatattaggtgagagtatccagctacaggggaaagtcatatgtattatatcaaacaaacaagcagaaagaactggacaacattgccagaaactaaaaggtaaccatttagagaaagggaagaaggtgcagaacgtgaggaaagaaagttccatagccaaatatattactctttaaaattaatgtaactaaagcattatagcaaaaaccaagagtaaattactgataaataaaactaacctatgtgtgatggtgatcacatgaaatcacaatacaaaactcctgctctgtgtagtaagatgacccctatgtaaatcaatggagttagacatactttaacagtataaatacttaataaacagaatactctggctctggtatctttttgttctgagctatggttgaaagggttctgtcaagttggactttgtcactccccaaaatacaaaagtcaagattgtaacattatgtccaagaggcaggtaggctaagggagagaaccacaaaacagctttctatttctgagcacatgttatacatgtgaatattattttctttctcttcggatctccccgtcttactgcagactagtgtgggatgtgtttgtacaaggaacatttttcttcattgcttttcaaactgtcaaattatctactgctaactacagtcatgagaccttttaatagagtgaacttactgaacaaaccaactattttaatatgaacttgctgaacaaaccaactattttaatatttatacagaatatacttatttgggtaaatcatcatatggtgctaaagatcactgaaaatctgtctctgaaagcagggtagcttccctaccacatcgatcccaagcatgtttgtctcattgtgtcctccatgacccttgtctaggctcctcctatctcctcacccccaacctagcaacagagagtgcaaaacagacccacaagtaaagtaattgtgtccttgtgaatacctagaaggtaaacaaatttcaacagatgttactatattatttcatcatataaaagtacctgcaatgggaaagaacacacagaggttaggccatgggtgatctgccatggggaactgaggcacgcagagaaagttctattgggaacttcatcgtgtctcagcttcttagctgcgtccagttggattttgtgaacaccaaatagataatgtcatctttatctgtcttctcttatttagaaacctcatatgagggagcattctgctctgcccagggttctattgggaacaccagctagctgccttaaaagggttttcttacatgaaattttgatagagaactttttgcagttatttgttcttttagttgaaagtctcacctgaaaggaatcttctgtgttgggaactcgagctagcatattaatggggcttcatcacttagttctataggatgttttgaatacccaagatgatgatgtttctagctaccatatattctatctatcatatagatacatattttattggttttaattatgtgagacattctgtacatgagtacggatgtccaaggaggctggaggcctcagattacttggaactagagtacaggttattataaaccacttaaagtttgggttcgctgaaagaagagtaatcatttctccagcaccctattttctatatctttatgtttatctacctaactcttttattctcttactttggcttactgttacttaataagttccctcattcaaatctaatagaatagctaccatatttcattttctggaccatatatattacatagttgttttttcttttaagttcactgtaaatattcgatagaagagtctaagaaatgacaatagttcattgacatattttgccaacactaagtgaataaactgattattttggtggcaagaataatatggtaaggtaattttaggcaggaaataaaagtatttaaaatttaccacagaaatatcacatctttggggatttttaaagtgatttcattcattctattatccatgttgtctttatttccaaaaccaatatagtaataaggatgaataaatactgtgctcaattagttatgaagactaagaataaaaatcatgtatgaagttattttcccaaataaatacgctgaaaacatctctgttttctgagttggtatgtaacatttgtttgcagtaactgttttctgttaaagagacatggaggcaagctgccacagcagcctgaattcttaaatcatcttgtaataagtacatgtagacaagtcctagctgttctatctagatcagccttccagttaacaaccaagctggcatgtgttcctggctaagaagaaataaagtccttgaagcaaaaacatttagttcagcaacccttaattgatcatttctgtacttgttacagagtagaagttgtagggacaggtttcaagggacctggacaattcggtcagaaggtagggagaaaggtttcataaagaactgagtatgtgcctaaggtccagagaatctactttagctagaggtgaagtgtccagtaggaaacatttctctgtagcactttcacagcaaagtgctttattggctgatgaatgaaattgacaagagaacagaaagaaaatatgcataaacttaaattcaaagagagtataacatgtaaattagcaacaaatgccacaaaatgcaacagctaataatagtaaagggtttagtctaagaagaaaatatgacttaaaaatatttgctttgtatgggagtgcatttttacacttacacaaatttaatgccacatcgcttcctcatgtagagaacatacatttatatgatcattactaagttatggaatttgaagcaaagtaattagcatatgaaaaatagaaatggtataacaagaattatatcattcaatgccaaaaagatagtacaatttacatatattccatttatcttttacaaagtacaaatgataaaacactccttccaaacaaaaagaaaagtacaaatttaggaactgtggtcataagttctaatggactgactgtaactcacagtgtcatgtgagtatcaatctggatgtattatgtatcttgtaaaatataatatccttcaatttgcttgaagttactgcatagaagatgaaattcattattttgaaaaatgtttgggaaaattaactgtgttctttttttcatacatgcatcataactgtaagtctttttattgttgttgttgtttttcagctcctctaactgataagccacctaagcttttgtatcccatggaaagtaaactgacagttcaggagactcaactaggtgagtcatttctcaattctacttaatacgcctttctccagtagatttcaatagctaaataatcctaaatgataggcatgctatactgtaaactgtaaacattgttccctgcaataccttctttggaaccaaacgatgcatctaatattcaacaattgttggtaaggagataagcttcttaagattttaatgatatttttatagcatattatgccctcaaactgtaatgtttgaattgattttaaaatagtatgtatggaattgtttgacatataatactccctaatacattaaaatacaattttggaaattgggaaaaaggtgatagttcatcaaaataaatgtcagtattataagataaaaaagttaaaatttaatctaagtaagagatgtacctctgtgatagagtgtttgcttagcattacaagacctaaggttttattcttagttctgcttattgatattttagaaatataccgctgaattctcatgagtggtcatgcttatatacaccttgcaataagttctgcaaacatgtatttcttaggaattgggcaaaacttgaaaaaacttgaatcaaaaagaaattagttcataatagtagtttgatgtatgtagtgaatataccaaactgaaaataatattatgctgattacatttttcataatatattatcaagatgtgagcaagtcatctctgataaactgatagatatgaacatgagatcatgaacacaatatatttgcaataaatattaaattctatactcattggaattttattatgtttatattggagtaagcatgatatttttgtctaatttgggtacatatagttatatcaaatctcttaatcaaaatatataaaatatattatattttttacattttaaatttacttcaaatattctgtgatgatagagagataggtagatgacaggcataaaacaaagttctttaaaatgtatttgcttttagtgattaagtaaaatatgttgaaacacatacttcaatatgcattcattctgatcaggaacttcctacattaatcatttaaatatgaaaatgcacatagttttaaaaactaaaaagaatctattttccacgtagctattaattcttaagtctgaatttagaaaaaagcgtgaatccgttttctacacaaagattcagaatgtcaggccctttacttgtaacaagcacactttatgctacacaaagagatgatgatggtttgggaactatggaatttctaatgctagaaatgattatgcttagtagcttaaagggcaaacatatatagggtaaggaagtcaatatgttcctttgatagcaactctgagccttctgaactaatgttatgtacacatacaagacatgattattttgagatggaacactgtagatagcattagcataatgtcataaataaagcaaacaaataaatgaaatttgtatataacagtttgtacaagtcattgtgtatttagtttattataatttattgctattttagaaacacaccttaaaatatgaaattctcatgagtgatcatgcttaaagttttactatcacatctagaaatgagtgtttcttaggagttaaataaaattcttagaacaagaagaaagggctgatagtagcagttagttgtagtaaatatagcgaaataaaatcttaagtctcaaattgtgtgtatttgctagacagaatcattgaaaaaaatatggttgatgcttgtattttgagtttcttcttttcattatccataatttggaatgaatcaaattggtctttacctcttacctttcacaaatggaataatttgttaagcagttttttaatattgctttttcttaaatgaactcacaaaaactagctaagcacatcaaagtgagatggaaaggtcttatgcaatgtggaatggttttctatgcattcatttgaggaaacatgaaaatacctttaacaaagtactaactcctttatagacactaattaaagaaacatgaggtttctttaaccaccaattgaactaaagacctcaatctggaattttgattattttattcaatgttttgaagtattttctgatgcctgttttcagctcataaaacattcattaaatggagaaaaatagagaatccttggttctttaagtttatttgaaagaactctcttcctagtactgctaatggttgaataacatccaaaagggatatgggtggcatcaaatgtctcaaatattagcaatctgaaggtggaagtatagggagtgtggttgggttacctagtactgcctatatcatttttggctacttagtaaacctctgtctgaaagaaagaaaaaaaaagagtgaaattgagaagtattaataaaggatccttgacacctaagaaaaaaaatttctactttgacttaccatttgtgtaaatattttaattttgaccattcttcaattagaaaaacctatcaattcctacagtctgaatatatggtattcagatcctaagaactcagcgaagcatcactgagtgcttttaggagctaagtaaactgtattagtgatgaatatcaatctctctctctctctctctctctctctcaaaagaagttcacatatctcccagagagtatgattagccatgagttcagggtttagtctcaaactgtaaattgaaatatggccttttttcaggtcaatttttaaaaagctaataacaaaactcttgactgtgctattagaaaacacatctggaactatacaaagttgtgtggctacatgtttgatcatctaattttaatattctaggtgaaaccaatatatatccaatcagctctggtacctataaatattgaggttttcctgacaagtaacagtaaacttaataaaaaagatgggctagggatgtagctctgtgtggaacagcacctgttcagcaatcataagcatctgggttgaaatcctcagcacccacagaaatagaaggtgtggtaacatctgtgcaatgggtaggagatagaaacagaagggtgtcactggcccttactagaggacagctcagctcaggttcaggaagagaatctgtctcagtggaacaacttgaagagtgataaaacaggatacttgacatccttgacacaaagtgacatttgcacccccccaacatggacacacacactaataataataagatggcatctagctatttcattcataggttttcctctcatctccacattcacttctcatgcccacctttcctttccgaggtcctctgtgtcctgctctaatttcttcatcttctcaaataagatatttctcgtattgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatttgactagtttagaaggcctccacctacaataaagtgtgatgaagagcttgagctaaagagccttcccagttgtgctctaattgatctttaataacttattcttatacattaactgtgtttaaaagcaaatgtttctgcttttgagtatataacaaggattttccagatgttgatacctaaaggaaagcaattgatacaaaaagctttagatttatgtaaaactcttggtaaatggatacacacacattaagttttcacactactacaaaatgatactattttctttgtttgtattatactgtgcaaaactttaaattttagggaaattcaaggaaagtggctaaaatatctgtaacagatcccagtgaataattttataggaaaaatttcttgtcatgggattcatatgtcaatttactgggttgttgatataattaattgttgaaatatgctttgctgctatgatttatacattataaaatgttattaaatatgtggcatattgaatatatttattacagtacatatcttagttttaattgaaatataacactatagaaaattatcttatggagtgaaaaattgattgattttatagatttcttaggcctgtaatgaaaagctgttattctcttgaaacaaagcatccattttttaatggttactactttactgtaattaactggacaaattttctttcatttcataggttagtaaatttaatattaatacctcagaataaacagtaacttaggcattgcatttggtgcacatatctgaaaatggcttagttggggtgtttgtctgtttgtctttaaataccatattactagagtatgaagtgacaccagtatgactttccttcccacagataggaacactgactaggtctttgcctttctttctatacaggaaaaacaataacatccaaattctccaaaagttacaatctgttttacctacttaagatagacataagcattagtataactgtactttctcaaataaagtttcttagacataagaggaacagtttcactttagtggctttggttttttcttaatcgtagcttcaactgactagaaccacagattaattcaaagtatctaatggctttcatagtctttacttccactgaaaacttcacaagccaagcttccatcatctgcattgctctcaacagccttatcttccaagttcccacagaataactcaacgaccaaagtccaaacgccaccaccattaccccaaaacaacatgagtgggtctgcaacagcaatgcctgatgatttagtccacttcttagtcttagttagggtttctactgctatgataagacactatgacctaaagcatcgtgggaagtcaaaggttaatttattctcctaagtctcaggacacactccaccacctagagaaatcacaaccgaaattcaggttaggaacctagaggcaggaattgatgcttactggcttgtttcacatagcttgctcttcatggcttgctcaacctgcttcactgatagcccttaggactatcacctcactggcgtcactgcctatagtgagctggggaacatcctgggaggagtttgtggagtgagtgagaggtggatatgatcaaggtacattgtatacatgtgtgaatttttcaataaataaataagaatttaaaaatatagatacttaatagtatgtctttaaaatcattgtgggaatgtattcagataatgtaagaaagattagtccagctccaggtgtgtattaagccatcaataagtgttgacttttaagagtagaaatattttcatgcaagagatagttttgatgtgttctttgaacactagcgtttgttcatgattatctactttcaagaatgcaatattatggcaacgtacatgagctacattgtaggatggatactattttggaaaattaggttctaacttcccttaacaaaacacatggatataaatctttatatttaaatatgcctatatatttaactttgattttatatttcttaatcattatatgtatatatatatatgtatatatatatatatatatatagtaggtacataattataaaacaataacatgttccctggtcatgctttaaaaaaagtttattggacactgtgccacaaaatgtttatatatgagcaaccaaaagaaaataaagtatgtttaaaattatgattctaaaagaatgaaattctagtgtctttcataagactagaaacacagagactaattttacaaaacaaagcatcaaaccattctcccggtcaagcttctcctggatggctttgtactagctacattcatttgattgaaaaaagaaaaagaaaaaagaaaaaaaaaagcagttttcctgtgagcaccactaccaggaaactttctagatcactcctaattattgaagtttactagaacaaaagagatagtaaatatcctacattagcaagaactgctcctgaatttgcaaaataaatgccaatttatgagaaataaacccatcaaaggatattatagtgtagaatgttgaaagaggtttcagaacaagagcatgccccatgtgactgatgtccattaaaagggagactataaaaagtctcacagcatttagattttgaatatagtgaaagatgttcatccatagatttcctcttgaagtttggttaaaaaattgagaactcctaaattatatgcagactctccaagaaaaaataacttgtgcatgaatgtcattacaaaaataagatgccagtattttacggtataatgttaagacacttagcattccagtcaaaactcactctaccaactaagtatgctcctactgatctgtggttaaattgaaccatcatcatttcaaagaagtgctcccttcatttttgattgatttctaattagtagtggcttaacatgtcagttttaagagtctctgtcctccagtctcttttaagcagctaatgatcactgaaagatttatattcacaaggaaaatatgctatttaaagatactctatggtgaatggttttatatgagaaccgttttgtaattgaataagcatgctcattacttctctctgtggtaatgcagatttttacactatcataagatggggttcatcaattcaaaactgcaagtgccattgtcctgggcaaaggaccatccacccatcatcaccaataattccctttagtctgtcagtagaaaaatatggaaactttcttcctcctaatagagagtaatttgattcattagtttcataatcaatggtattttcttctaatctaattaattgaacagtaatattgtagagtatactacttaaacaatgacaacatctcatgtttaatgaggttaaaatgcactgttttcatgggttatatgttttaaagccatcctgcttgattgtttgcttccattttattgaaatgcaaaccaacagaaagactgtccataatgcagtttatcatccatagtcttaaccaggtgaaagttcggattactttttattagcatatattgttattagctgtccaaagtaagggtttcattgagatatttctatatatgcatataatagcagttgtacatattcatccaatgtattagtcattattaaaagaaaaattatatttttactttttacaaatttatttgtctcttttctttatacccctgtagcaattacctcattttaacttttattttaaagataaacctttaggtattatgatttaacttatagctacatgaacaaaaaataactatcacgaatatttttaaacatatgctcctaaacacaccacatggttttatatgttgagtaaccataaggtattaaaatctaaaccctacagcagtttacgatgtataataagaaactgaggggctgacgtgatactcagaggttaagagcactgacttctctcccagaggatcaggtacaattcccagcactaacatgacagctcacaactgtttgtaactcccattccagaggatttaatgctttcacacacacatacatgcaggcaaaataccaatgcacataaaaacaagataaataaaaggaaggaggaaggaaggaaggaaggaaggaaggaaggaaggaaggaaggaaggaaggaaggaaggaaggaaatagaaacattgtctcaaaatgttatttttaaaaagaagttgaatagcaaaaaaattaaaggttagtagagttttgattttcgaaattcacctgtttttaaataaatcagaatgtaactccacctccagttgggaagaagagaaagctgtgaagttgtttaagactctaaaggactcatcctcttccccatcctcttctgtcaaattacctccttaaactcatagacaaatgagtttctagtttaacagaagcagaaggccttccttggacttccctgctataagttatatttacagaaagttagcagctctttaaataggaagatactaaggggaagtgtgtatgtgtgtgtgtgtgtgtgtgtgtgtgtaaaataaataacatatatacatattctttaaatacatacatttatatgtatttatatgtattatattataaatgtatgtattaaatacatacatttataatatatagcatatatgtatatataagtgagcatatatgtatatataaatggtgtgcgtgtgtgtgtgtgtgtgtgtgtgtgtgtgtgtgtgtgtgtgtgtgtgtatttggctttttgagacatggtttctttgtttagtcctgattgtcctggaactcactctgcagaccaagttgaagtcagaaatctacatgtgtctccttcccaagttctgggatcaaaggagtcaccactgcctggccaaggagatgatgtgtattgttcttcaggaaaagatggaaaaatagaactgagcacatcaagccagcaccaaaagcagcgtacttgcagtcctaggcaatactgtcattattgctatcaatattcagtaaaaaactgttttgtgaaatagcataggagaaattcagaaagtgttttatttttgctttctaaaagaaaataaaatgccccaatgaacatgcattcccagatgagaatggcattattttggcaaatttatggttttttaattaattgatttcctgaaatgcttcctggaaaatttattattttgaacaaaattatttgaactaaaattgtattattccttggtactctaattattagccaaaccttgtttataagtagtatcaatactatcttcaaatttatccacaacaaattgtattattaaagatatatatatatgaaaatattattttatgtatggctctttgtaatgacaaagactgtctttactaagaatatttttcaatccaaaggaatttcttaagaattttacctatagaattgaagtaatagccttatatattgaaaaatcaaataaataatagtttgattagaagtatcattgacatttcaatttgaggtgaagttgtgtcatcgagaatattaatgattaagtttgaaagacatgttcaaacaaaagcgattcttgctactgttgattttaggaaaaatggaacagagttttctttgtttaagttgctctttagtatataaaatgaaataaaggaataagtcaaattatcaataaccaagagagagaagaatcaaaagtttatgcctaaaaatatctcttttagggaaaaggttaattttgaaatttctttattggctcagtttcaatagttagctatgcctttgccttttttcttctcttttccattctcctctatccctacccatcccaacttcccttcccttctcttttactgcactccctttctcttatttcctttcccttctctttttctttccttttgtccagtactagggtttcctgagataggcttggtattagatttcagatacaaatgctcaggacttatttaccttcatttttcccacactggagttcaaagttggttggcggcttcgagatgaactagaggtgataggaataagtcataccttcctacattcttcaatggactgtttttcacttcgttatactgaatgtacgtgctgtgatctctcattgtatttatgtagatctcctaaaggcacttgtttatgtaaacttcagttttgcaacttggtgtatctaagggaagaggtaacaggaagattttactcagctccactggatgatttaaatttgaagtgtgataggttctgatagtttatagtcagtgtcatggtcataagtgacaaataatttaaaaagtgtgagggttgcaggccataaggaaaataaaaacaggtctataatgttgtcttctttcctttctgcagaactagttaggcatttgaagcattctgagtgtgttttctttcccaaactataaaccttttgttttctccaccaacaaattctggtattccttccttttgtatatacatatgcatgcacataaatgtgtaagggtggaagccagagcacaacttcagctgttattatcactatcccagctaccatttctttgaaacaggatgtatcacaagctgggcattaaccaagtaggaaaggctggctgatctctgagccccagatctctgccttgactctgcctcccagaactaaaattacaaaatactgccatgctcgtttttaaatgtatattctgggaattaaactcatgcttccaaagcataaagtttattcacagatatctccccaattgctcccctccccttccattttggtccatgtatctcagatccatacctacactcctcagattactctgtccaatgtagtatgacatttttaactgtaaactcaatgtcagttgtaaattaaacacattctcagttgttaactataattttggaggaaagtatattttctgtaatatgaaagtagcagagcatgaatcagtgtcaattttgtataagtgaataagatgaggtcagatataacacagcgatgaaggatggggatctaaatgacttagggattataaataaatatatatatatccacatatatgtatatatatatatatatatatatatatgaattcatattacaaaatttaagttccttatgtaggataaatgtgtataatttatatgtgtgttttttataaaattttacaaattatatacatttgtatataccatgtatgtatataatataaatataaataatttgtaatgtgatagaatatatatatatacatatatgttctatataagagacttaaaattcactttagtaggatataagccaaataatacatacatattgttagtttcagtcaagtagactgagtgtctgatccaataattggaaaaaaacagtgtttatataagaaaatacagcttctcggtggttctatcttttaaaaaaatgtaaactattaataatactcatgaagacaatcataaaatattaatctactatcctgccacagattggagcacagtacaaatctattcacattatatatgtacaaactagtgtaataagatctatcttctcagaaccaaagagcttggggaagaaatgaagataatcatgaagagaaaaagattccatcagatgatatagggactatggtggcagaagcgagtggtcaaatcttctttgggaatctggcagcacagaggcgatgttatgattatgttgtcacatccttgttaagaaaagtagatgcagctgttaacctttccaggagacagttttacatttaagtgtaacagtacatatccagaattaaaccaattatctgtaagatacacaatcttattaacttatcgagtgtgtctttgaactttgtctgtaacccaggcaggtgttgaacttgtagttttcctgcctcagcctaccaactgtttaggataacagaattgcaccaccagacctgccttttaccaacttttcctctacaaaatttcaccctggatatctttgctcctgaatccctttacttgagaaatggcattacctcatttacttgtaatggtgtaccaagatagtagccaactttcctttgttaattacagcctacatgtagtggtttttgtgaacttgagatgatcatcattcctactgtgggaatcagtatggagggttgagtcaacagaaattaaaaaccatttatagtaagctgtgaggtttttagcaaaaatgcaagagttaatttgcgagatttgcagtttgatttaataagaagatctcctttataatttgcagtaataccaaaacctctactatgaatattgtgtgctgatctgctatctagaagataaaaattataccttccataatctgaccatatttttatcttcatagcttcattcacagccctgttacactcacattattgatcaaccattcctaaccttaccatgatcttcaccaatctataaattttcatatactgtctgtaatctagatcacattggtatgccttccttattcttgtgtacatacatttaacacacacctcaatatcacctctgtgatgccttttctcctaattacattgtcactaggaagaattaaacacaatcaccaagccctagtagacactcaatgcaacactctctttttgtatctgtctctctgtctctgtctgtctctctgtctctccgtttctcaccccccactctctcttcctggctgtcctagaacccaaggctcactaaattactcaggataaattggaattcaccttgtatctcaggttgcctttaaccctatgattcttctgcctgactagggtagcaaggattacaatactgtgtcactgggttttgcttatctgtctgtctgtctctctgtctgtcttatgtctccttatttctttatctattaagttttaaccaggtcttgcacaaggtagacacgtagtaacaaagtagcaaattggcccagccaaacaatttatcatttagggcactaaaactgtaatgtctactgggctaaactttagagctctgcccccaaactcaaggtgccagttaactttcaacccttgaccagtttcctagctgaactgtgaaatgcaactgttctgttaacccctatttatatctccaaagtcaacctactgctctattgtgaccttcaatatccagctgatctttcctcctctgttcaatctggacttgatttattgctaggcttctctagctagactcctcgatttttttttctctatccatctccctcatccatgaaggagaatcttcaatcattcattgcaataaaacaaatactagcagttttattgtgctttatttcattattctgtagtgtacaatagtaaaaagagtaagcgataagtgtgggattttattttatttttgtgtattagacctcattgaatgatacatgaactgggcattcatatgtttctcaggcatagatatcagagagacaggcagacaaatcctcaaaataaaaaggctgagcttgtggtttagtgtgagaaaggttctaggtttaagtcctaagagtctaaaaagtaaataagtcaagatataaatgggtagatacatcctcactgtaatttgtattatcatctcagttgattctgtactccttattctttaagaagaaaccatgacttttttccttatagtttcatccttgattgaatgtcacctatcatttaaatgaatcctttaatcagaatctgtggatacagcttttcttgattagtgaccctaatttctcattgactctgaagaatcttacatttgtaaagcattttatgtgttgtataattttgtttttcaatcaacctgcagtgtctgtacgcctgcttttacaaactgtgtccaaaaatttgtgtgctccagagtatcccttgttttcttcttactttgggtgttgagtgccaattgtgagccatcctctgaaatctaggctgaagtataatagtaaaaaaaaaaaaagttgtttcaatcattttgacttttcatccattgttaactaattctgttgctcatcaaataacatatctagatattattaagttgaacaccaacttgaccttaaaacatttctatcttaaccagtttgagttgctaatgcaggtaccttatatagggtaattcataaacaatagaaatgcctttttcatgattatgagtattagaaagcctaaaatcaaggcaccagtagatttcaggcatggtgatggcagcctgtttcaccaagtggtatagtcttctgcctgtgtcctcacgtgttataaactaactgcagcactctgggaccttgattataaggaaattaattctatttgcaaatgtaggacccttgtgactttataacattccaatggctctacctcctagtactccactttggtgactaggttttgaagaaaaaaatgataaagggacatgagaatttagataaacagtttctcagttatttctcactctcctgcccctgctattcagttacatgtctcttgagtctacttctgttcatcattgcctactagtttcttattccaattttttgaacgtctgatctctcaagtacattttaacagacacttttcttcttacactgatcttgaggcatgaaatttcttttcaagacacttaggaaaatggaagtacttagaatgttcatgaacagaatgtcttttgagctgcaaaagttaatgtgagaaaacctgatagaagagtcagttagctcatcagagtttttactccttaaaaggcagctagttataatctcttcttaaacagcaagcacaaagcaagtgctctcatttccctgattagaatagacaaaataaaactaataattgacttgtcaatttactgtgactattaattccctacacacaaagatggccttcgttaatttagggtgcacattttctttccgaatataattatctgactatatatagataagtaatttaaagccagctaatgattgtttgagcatctaaacttaaaaactcttgtagaaattagtaaattatccatttagaaaacctgtaacaatttcatcaaaattcatgttaactggacccatgatatttcatgacatttagagtacgccttatccatggcttgtaaatatacctacacagtgaagaactgataagctttacatagaaatagaagtgctttgttatgcgaatgcatgctgcattaacctaagagagtaatttgcaatgcttgtgacatttactagattcaaggctccattgtatcaggagacatccaccaattgtaaaaaggaggacggaagcaggaccagagaatgcagctcagtaggagagtgatttattgacatgtgttaagccctaggatttattatcagaaatgcaaaatgtaaaacgaatgactcatatttatggactaaatgtcaataaccatagattcaaaatatttgtattcatagcacagtaatataatattgaaattaaaatggaactgccatcattatgctctgtaagaataacttcttagattagactataatttacaaatttccttcaaataacaatcaagttagtccttgagtacagaatacaattttatattctatgtggtagtcaacttttgaatcagcacatgaatttattttaattattgtaaattaacgttatttttctccaaataaagggatccttggtattgtggtatggaagcacaagctaatggcagtggtaacacccctaactgaatgatgagcttgtcattggcatgcttgttagtggcgaaaaggccactttgtcttcaaacatatcataagttactatagagtgttgagaagaagggaagcacctagtttccttgttctccatatctctttgccaactcccaatttttattttactagatcttgaaaggaggttggaaatcaatgatctctgatattttgggtattcttaacatctatgaacagaaaatttacacacacaaacacacacatacatatattttcatacatgtatgtatatgatgaacaagtgcatgttcaaatatttgagcacaagtatacatgtcagtgtgcgtgtctgtttgtctgtctattagtgtattgtgtatacaccaagaacaggttggtgtttcgtcttgctagatctctgtccactttatttcctaagtcaggttgtctctctgaacctggagctcactgatttaggtggtttcactagccaactttcttcatggacccttgttgcatctctggagcactagaattacagacatggcagaaaacttggtgtattagtaacattttattgctataatgaatccatatgaccaatttaacttataggaagaagagctgatttgggatttgcaattccagaaggatgagacattttcactatgatggcaaagaagtttgacacaaaacacttgtcagggatgaaagagaaagaactgcgtaaggtcactattagaacatgtccaagatggggaaagttaggttggcttgggtatggggcagttttaaagccaactaaaccaaaagtgaaaccaatttaattgttgaaaaggaatacttttataaaaaattaggaaaccaaattattcatttataaatatacatgtacatatatataaatgaataattatatatacatgcatatatatgtatatattagtatgctctatcttgcttaattgtttcaataatatttgagaaagaaaaagtaaacaatttctctttaacacaaattaatatctgattttctgaattgcctctttaaaggtatcattaaaacataccacacacacacacacacacacacacacacgtaaaacatcaaagaagctatgctcatgtttcagttgtgagagactctacaaccttgtaacctggttaaaattaacttatttctcacaaatgctgctctccttttatgatagttttcttatcattgttgccttcttcccagtcagccataatcaaagcaaatgcctttgatttttctccatcatcttgaatatctttctatttttgacatagtaggatgcatgcttctaattgtttctgaaagcttattgacccactatagccctttccaaatcttacttcgtttttttttattattttctttttttacacctcaaatgttatccccttttccagttaaaatgacctttccaattggttgtctgcttgctgattgtttttcttcttgtttctttactgtgttaagtaactgccttactaattgggttatgtgtgtgtgtgtgtgtgtgtgtgtgtgtgtgtgtgtgtgtgtgtgtgtgttgtggtgtgttttaatgatacctttaaagaggtaattcagaaaatcagatattaatttgtgttaaagagaaactgttttctttttctttctcaaatattattgaaacaattaagcaagatagagcatactaatttttgagtgtttttattttcttctttaaataaaggtatgtgttatattcttccctgaataaccaacagatgtattaccttcagtagttattggtgaagtttgggttatgtcttatgcacttttctatttccatgaagagacaccataaccaaagcaacttttataaaagaagtttttactttaggggtttgtgattctatgacaatcatgggagggagcatgacagcaggcaggcaggcaggcaggcatagcactacagcagtagctgggagcttacattctgttccacaagcataaggcagacacacacacgggggtgggggggagagttgggaatggcatggacttttgaaatctcaaagcccattcatagatatgcatatcctccaacaaaggaatgcattgtaattttcacaaagggaacaagtagttaaatatatgagcccatagaggtcattcttattcaaactaccatagtttgcactgtttttgagattatcttgtttttattcacccaaggttactagattgtttcaaacttactagtatgccccaagtacaaaaccccttaagagtcttgctagaatatagccatatcatttcatttcacaatctttcaaacatccaaatgttttaatttattttatttatttgaaaacataacattacaatttcattaaaattgtcctggatattttcacagatgagtttacatataaacaaactcattcataaatacatcttatcatactaatctacaacaagggactatgccttttattttctgttaagttttcttttcaaactacaattaatataaacaaatattttgaacaattgatattacattaaaaaaactagtaaaattaactgagttaaaaatttttgtacttattttttgaaaataaacatatacttggtgattatttggagatgtacatatttatatgaagtacttgggatttgcttgcaaattttaggatgtcttgttttgttttcttccttcattgtctgtcttaccatgctatattgattctcgagtgtctgaggaacttctgttttccagctcatttaagtgcatttcagcctgctgttttggtcatcaagtagccatataatgaaatgtgttttgaaacaaaaggatattgtatttgtccatagcttgggatttttgaatcctggttgctcattgtacttagaaaataaagagtaacataggctatcttcataaaagggtaaagcaagttatccttttattaatatacataatttcaagacatttagggttcatgaatcagtttaagtatttgaataaatagggaaagtagtaaataacataaagtcactaacttgacatagattgtgtttgtgtgtgtgtgtgtgtttatgatatgcagaaatcagaaaaggtcatcattatcctttgtcttgtactggtctccaccttaatactttgacctatggcctttcagtgaaactattgttcttccactagactagatggacagcaagctctagcaatctttctgtcttgtcccaacccaaaactgtgattgcaactgcatgcattcatgtctgaaattttactgtgctgggaatcctaactcatagccctcttcttatacaacaaacattcctatccactgagccatctccccaactgccaaaggattcttttttaataatagtaaaaatactacttcagcaattataaaaatttaatatgctatttattaaagggataatttaaaaggaaatcttagagattttctcacaagaaatactagccatttaaatgtaattaactcaattttatatttcttttaaaactcactatgttgttcccttagggctgtctttctaaattatgtatcagagagcaattgaaatcaaggacaacagttactgatcataagctgcttctagaaaataaagctataaatgtatcttttgtttattctacactaaaataaaatatttgataattaatactatttaaacatgtgactacataacttatacaattctgttttgtttttcctgccttgttttccttatagatttatggattcatgccaaattatctttaattctatgtccatttatcttcagaagagaaagaaatctttctatttctgataagtctaccttgggtacataataatctgtttttaatgttaggaatctggtttctagcattttataaaatggtaaaagaaaactaaactgtcaagtcttcatggaatttaagcaacaactataacactctatttgctaatctgacagcattgtaaattaaactgtatcttgttatgtctgctatttctcatgtgctatggacaatgtgtgaatggtgtatttaatgagaagttcccccattatgctcgagtattgaaaatagtgtttgagtacatgctgcatcccagggggaagaagtgtagcccagggagtgggctatgatagtttatagccttgactcactcctatttcactttccattttctatttgcttttctatttacttctgttgcctattgccatgctttccctaccattaagggactaaacttctggaaaaatgggctaaaataaattattccttccttaacttgccttaggtcataatattttataatagccacagaaaaataactaatacagtgaatgacagtcatttttaattacctcctgaataattgcagtcctattcataaatcttattacttatcacctttttaatacccacaacatggaagtatactaataacttattttctttatttttaatgtttaagtcaaccatgctgattgtataggaattactgttgagtactcttatttaactatcaactttcttatcattttatctttaacttcctagtgtgagactaaacttattaatgtaatataagatttggcaatactattcttatgtaaaattcaccatctaggatgtcttccttgcaagaaaactcgtacatcagatattataaacagctgttccttttgtttaaattttaatatattataaatatcagagtgaaaatagagtgtattgtgttaattctttggaatccaggcattttctatacacttgaaacaagagtaccctggaactgggtataaatagatcttgctgagaacagcttttcatcaatcattttatcctgtcaaacaagggactttttttttctctttaaatttgcatccatttataaagatttaatttcagcttgcaaattccatgttatgctttattactggagtaagagagttaggatcatggtttgggtatagttagcagatttatagatggctcaatgtgcaagtaacatacgcacagatggcattggagcctaatgtgtgtgtccatttgtgcatgtgtttatgaacatatgaatgataatatagtgtaacggtatcctagtctgccaaacagtatgacttggaagtagcaatactttatttcttatagttttgaaggttgctaggccctagattaaggcactggtcaatctagcaacagcccagtttctgatacaaaacctgccctttctttttatggccttatacagaagagaaagatcttttctgagactcttttatgtaaacattgttacctttcatgacagctttgcctacatgacccaatcatttctccctagactatagtgattgccattgagatttcaaaataggaatttcgatgaaacccactttcaggctgtaacaggtagttgtggttacagatttttaaagtatgctgtgaatagatgtctttagggactcaatatataggtggttatatctgtgtctcaggaatggacagggctccttcaaggaccattgactttgagactcaaaggtgagcataatttattcaggtagaagattataggccataaccaaaagtggtatcagcaaaaacctatgaagagcaataaatcggaatggctagagtaaataaatcctgtggaataaaattaatgaaaactcgccctgaggtctaactatggcaataactaatattgacttagtgctgcatatgtgtcagacaccatactaagaactctgttaaaaaatgatccatttaaaataaaaagttggtcatcaatgacattttaaagtaaagactctttagtttgggagaggttacctaatgttacagttatttgtgcctaggagacaaatgtgaggagtttgacttagtgtttgcttcctgttgctgtgctaagtgccactacagaaagcaacttggatggcaaatggtttgtttcatattgtaggttacagtctatcatcaagggaaactggggcagaaactcaaggcctgaatctggaggcaaaacagcagcaaaagaacagtgcttactgacttaacttcaggctcatattcagctacattttttgttatgcagaccagtactacctgcccagaggtggcactgtccatagtgagctaggctaacctttatcaattagcaattaaataaagcccaactgaaatgatctcaggccaatatgatgaaggtccctttaattactaaaccatagtcactgttttcaaggaaaatttcatggtaggtggtaatatttatgtttataatacaaataatttctattttagcaaatttaaggatatcttgtattaccttggataacttgttataaatcttcctcaaaggattattaatgctttaaagccaagagagatcttagatgacaatgttttaaacttttaaatattgacattttggcctaaatgatttttgggtataagaggttacatcataccatatggtactcaacaaccctgtctctgtgtgctgagcagctgtgttactcccctaggtgaatcaaagataatcctctggcattttccaatgtttcctataaggcaaaaattatctcaccactaagattgagaaacccttgcctctagaaatctaataaaatctcagaaagaaaactgaagtatggtcatacagcaaatatcacaattttagcactgtattatgcctccttatcccaaatccaatatcgtaaagtaaataaattgccaagacagtgtcttctgtctaaagccttgtacaaaactagagtttaaaaagtgttcacctatcacccatagttacgtaatgagatagatctgataggttagtacaaatccaacttcatcccaaatgtgacccttcacacaatgattgaaatgacaactctggtgttctgtccaaaactgatgccactcaccttagttaatcagtatggatctctttgaagaagaagcgacagattatatctcgagaacttttgtatatcatggcttcctctttctgtaccctgaccctctacattttgcggatagaataagagcaatgatcttttatattcaacatggagaaaggagtgataatactttcatgcatacgtgcagtttactaacttgtttatagggtctgaattagctaagaattattgagattaaagtataaaatgaaggttaaattattttatcttataggtgctttaactatagattcctggtgacttaaaaagaagtgctaattgttcaaaagcttctgctgtcttgagttgtgttgtgggtctttgtcatacagtaacaaaaaatcaaaatatttaactaattacttctgtctgtctatcattgtacagccaaagcagaggttctcaagggaacaaaggacaagcatctgccagggcacaatgctaaagtgttagccctgtctgtaaagtacagagaaactagttccaatttgttcccaagctataatatagcatgattatttatttaaaaaaataaattcagtgtcaaagttttaattatctgtagtgtttggacatgttttttcctgtgtctagaatgttctgtttctcaaaattttctgttcctctccactctaattacaatctaatgtaggtctagaattgtgcatttgatgtctatcttcctctcttgacttgaaatttcatatatacaacaaagtatgtttgaattgcttgcagggctcccagagtgcctagcaaagggccccaataaacatgaatgattaattatctgtagtgtgtttcctgatgtacactgaactatacaaataattaaggacaaaagaatatggcatccatatttgcctattagtattttaattttctcttaaaaatcagtccttagataatagaagacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctcccccctctccctctctctctctctctctctctccctctctctctctctcaaaattggtttttgtatataatgtagatggttaaataaagggtctttcaagtcctccctataattatcaattttgaaaccaatggaacaggatacacattagacccattacatctaatgaattgctaagttctattggcagtacttcctcaatatattccaaacttgctcactgatctccttcagagcagtaatgaacacattagctattgtcagcatttcattaggaatgttgaagttggtttttaattgttcttacacatccacacttgccctctctaattaattttgctgtgaactgccacgatgaccattataacatttaatatgctccatggcatcatctttttaaagcctttccgatggatttcaaactgcagttggaataaaacccaaaaaacctgttttttgttgttgttgtttttttttttttttgttttttagacagggtctcactatgtagacctggctggtctaaaaatggctatatagcaagctggcctcacctcagcctcatagagatctttgtgcctatgcttcccaagtaatgggattaaaggcatataccaccatacctggctaaaagttttcgttcttgatattgagcacaaagtcttacataacttatctcctctaatctctactttgtctgccttccttccattttactgtgctctatgcatggtttaccacaattctacttccctcaagtaaagtgtttggacatgttttttcctgtgtctagaatgttctgtttctcaaaattttctgttcctctccactctaattacaatctaatgtaggtctagaattgtgcatttgacgtctatcttcctctcttgacttgaaatttcatatatacaacaaagtatgtttgaattgcttgcagggctcccggagtgcctagcaaagggccccaataaacatgaatgataaagaaaatataagttatgagttgtaattcttactattatggttctaattctaaactcatttcattaatggttgtaatgtttctactcagactgtagtcctatgttctttttgatatattttcattaatgcttcaagaatttcatgtgtacaatacagtgaatttaaatcttattcatatctactctccaaaccctgagctcaacctccaatatctgccaactttgtgttatttttatttagttagtttttatagtccactgattcccatttgtgctgcccaggtatagtgccattctctggagtgtagccaactcatctgtggtggcacccttaaagaaaactaagtctctcccactccaaattaatcaactttttttttgagttttaaatagagattttttttattattttacatcttgatgggcttcttagagctttgatgtgctactttgtttccggaatactggaagaaagtaaaaattggaacaaaatatatgaagaaaaatagacagtactagtgtcaaattaatcaactattaacagctattctgctaaggttggggtctcctccatacgacaagctgaaatgttcactagcttgggtacttcccaaatgctgtaagttcctgagtgcagcaatctggccatatgcagaagacacatttttttaattagttcttctagaactctgactcttacaatctttgcaatcctttctccaacatggctcttgaggctttgcaggaaggagatatgcagatttcccattagtggatgaacaggtcacaggaacactttctctatattggggctattgttagtctattgtcctttattcttaccttgataaataaacatgactgtctgtcataaagtatcttaacagttttaagttttgggagtgaagacaaatatttgtgcatatattgaatcttagcactgatatatttgtatattgatttggcttttttaaatcgatgttttaataggtaaggattttgcataggatataattcaaaccttataaaattatggacaaggaaaattttccttttgaagtccagctatgtatctagtctttcttccctttaggcaaatggagttttctgttgcaaggtactttttaattttgatttaatgatttttcaattagctttccagtttgttttccatctattttgctttattattgtcaaccttgagttcactgatcatagaaatgattttcttaatgataagtaatattgtatgtctcatgaaaaggtgccatacgggtttaagtatcttcttatatgtgagtctactatgcagttattttatatctgaatgtttttttctttttataagataatcatttgttgaattattttgctttatagataaaatggtggctaattcttgaatttaacttatataaacattgcttagggttttaacaaaaaaactcaaggtcttatttcaaggtttctattccttttagaaactactgccagaaatagcagattttaagttcatgaatcttgtcatagcaaattagttcttaactttctcttctcagcaaaaagtgactaactccctaatcaagacttttttcccttatgtttgattagtctgacctttttgggtagactaaatgttattgatttttaaaatagctttaaagagattccttactagtagaaatgtatacaccagtctaaattgaaagaatgacttcactcaaaagttcagaaaagagtaatctttatagtcaatctttgatttacaagttgattttttagagcataaaatatggttgaacaaattgaaggatttatttcttgctatcacacaagtatgaaacaagcttcttccctttacttggtgtttctctatgtgatcttctcatctaattgattattgctgtctttcttcattaaaagaagagaagaaactctcgtttttaattttttaatacaaaagaaaattaagaaaatgaagtcaagcaattataattttcttaagacaaagacttgtttcgttttcttgttgaatataaaatacatatcacacaattttcattgttttgtatcacagactattaaaattatagtatcaaattatactcaacataaacatttgctctgatacttattcagaaaatatagaaaattgttgtacattgtgtaagcaaatgactattttacatcacaatacacttatttttgcaaattgagttgaaattgctaactttaatttcagtctaaaaccttatttttaaacctattttctttagttcattcttgagatactaggtgctttacttaatattattaatctcctggttttattttgtcttaatataggtgtcctgaaaacttactatcttaaaatagtaataaataatttaaaagccatttaattaagaaagtaatattttattgaattgcatttttacttcttgtcagattaacagtattatatttttcaacaagtttatggtaaaaagaaataaagtaacattcacataatgtatttttagggaaagcatacgatcacaaatttgcatttatataaaaatcaccatttaaaaggtattcacttaaaatactaaagaaaataagtttgtagacccttattagataatgcagcttattctgaaatatacctatggagaataatttcagttttagtcacaaacatttaatggactatgccaaatgaataaagttttaaaactttacttagaaagaatattaaatgatttttaaaattttttattagatattttctttatttatattccaaatatccccttaccaggtttccactccaacaacgccccataccatctcccctccctctgcttctatgagggtgttcccccacccaccctcccactcctgcttcccagtccgtcctggcattcccctacactggggcatcgagccttcacaggaccaaggacctctcctcacactgatgcctaacaaggccatcctctgctacatatgcatatgcagctcgagacatgggttgctccacatgtactctttggttactggtttagttcctgggagctctgaggggtcttgttgtttgatattgttgttcctcctatggtattgcaaatcccttcagctccttcagttctttctctaactcttctgctggggacctggtgctcagtccaatggttggctgtgaacatccacctctgttatttgtcagactctggcagagcctctcagagacaactataacaggctcctgtcagcaaacacttcttggcatccacaatactgtctgggtttggtaactatatatgggaatgatccccaggtgggcagtctctgggtggcctttccttcagtatccgctccacactttgtctctgtatctcctccagtgagtattttgttccctcttctaagatattaggtgaggaggttaatgtgggactgggctctactaatgtgcattttgatttgttgtggttttctgtaatgatccctgttgcaaagagaagtattctttatgaggggtgagggctacacttgcctatgaacataaggacaaatttaagattgttgttagggatcatgctactgtagtaaagtagtagttgcagattctcctccaatgtccatacttcactagcactgtatagttggctatgtttccagaatcaggcatagattcctgttggcaatcttaaatctaattagagagacctgttgagtatctccaaggtatgcatgccactactcaaccccgaggtttacaatgccatgctggttgttaatgtagttcataggcatcttggctgtgtaggagtgttggttgcctccctcctttagaagcttgcaagctgaattttactaccatgaaagctagtcctcagggaggaagcttttagatctgtcctatattagtgatctctcgtccctgtttttgaagtacatggcatcttcagcagtggggaattaccttccacctctggaaacaaccaaggataataggagtaggctgtatgttttggaagtctcttggatagccctggcagaaaaaatcaaaagaagcattcttatgtctggaattggtttatgtttttggtttgtttgtttgtttgtttgtttttgttaagtggtctttggttcttggaaggagtattgccagtctagatgacaaattttattagactatatatgtatacttatacacagaattattagtattataggggtttgtaagtaaatagttaataatatgacaatcttacgatttttcaaacatttttactatcattttagcctccttctttctgtatttacctccttccctctttctaaattgcccctcttatttccctaatgagatctctaggaccctgctatcttcctatttgttactgaatcccccaatccttataatggttctgttttactttctggatttctgctatgtgctcagatatgaagatttggagttagaagcccccaatgagacagagcatgtgaggtttgtctttctagagatgtcttgtagatagcatggtcatttcaaatgagattgtgggcaaagtgttcctagaaaaaatgtttgttctagagatagtctaaaaagagagccccaatcttctgaaatttcaaaaagttatgaaaaaggctgacactggactaataagtatagatcaacaagagacagacagggtaaccccttattgatgaataatcaagatttgtaataccatcccctcatttggaatagatgaaaatttatattagttttaatatacaatccaaaccaacttataaagaaagatagatgtttaacactttctcaaagagtaaaaaagaaaacctttaactgatttgtgcacattgcacattccatatacttacgttattgcaaaaatgtatagcatctttgaaagtttatatgttcacagagaaaaacaaccggaaaagcagccatgacaagattcaccctgaggatgctgaaaggattctgagatactgaggcatatttattccatcatcctacttgatcctacctcagaccccctcagtgccatttcctcaaaattcttcatccagggcagcttcaaaaaaagctgctgaccccaattggtccagcatcacagcctgtccaatcaggacttcaattaagccctgaactttctcagaacatagagactggatgacaattgttacagctaattttcttaaaacttgaccattttccaaattttcttgggcaagaaagctatgcccccaaatcagcagaaagcaattttaagagagaaacaccccattcccaaaaggcagaatgtgtggttttttagttgtttggtgggttatagatatttgtcaccaactaaggagggtgggtacaagttgtaatggtcttatgttagggaggaaacaaaatatagggtgttaggctcagagatttttctttttttcttttttcttttctaatgtatttatttcttccctatctagtattaaagggaaaaggaagagaagagatgaaaaggggggggtagaatattacaataatagaaaaaaaacaacactgctcattgaaactacttttagaccaaagagttttaacaagtcaaaagtctgatattagtatatatctttatatattgatataaaattgagcttatactttgatatataggtatagatctttgtatatttatgtaaatttgcagttatattttgctacagcatactatatagacatgttttcaaatcttatttgagacactgtacttaaggtgattcttaaaaatggaatattaagttccagttcttttaaaagctgctactacaaactgcttatcataaataatgcaagttaatagtcaattgaacatgtggtcttataggttctagtatagttatgtacaaaataagttgtatttagtctccttatagatgctttcaaggttaatcagatagtgaatagctagaaacagacaattcacatgtactatggatagttcaaaaacatcaaagatctataagatatgacatttaaaaatattttattattaaaaggggtttttagtactgagatatgtcagctcctggcagcactccttttctacacaaagaagatgataagcattgaataatctctttaaggagtttgttaaatgtggcaagctgctgctgggcaagaaactgcccttgcttcaactgaagatagaatgctgcccaaaatggacaaacgggatcaagggaaattgactggcaaaccttgcaaggaaaggataaagaagtccttcatcattcctgcttcacaaaaaagtctgtcagttatactgggccagaacgttgaagattgatgctccaaatttatagaggaattttggggaactgcccaggtagccaactttatctgccatttctctagttttggaagcttcttgcctacatgccctacatacttaggtaatatttattccttctcaggtatctgacgaaattgaagactagatacttatagtttcataattatgcctaaattgtttagaacattttaaaaaaatgttcttgaatctaagaagatattttaggtttataattttatgataaaattgattaaagtacagaactctaaactcaccaagataggatagataatagaatactttctcgaaattgtcaaaacatatggactgaacattatgaatgtaaatcttacctgtcagttttcataattaatattgtatacagtttatttttgtaagaaaaagatactcttgtgggagtaaaaggggggaaatgtagaaataatctcttgtgcactgtgtaaaagcattcacctatcaataaaatgctgattggccaatgagcttaggcagaaaattagaagatgggtcatccagctgagaaacagagagagggatgatgggttagagacaggcaggagattagcccagaatgtcaatagtcatcagcagtaaaaaaaaatgaggaccaggtaaccatccatgtagcagaaattaaaatagaataatgagataattaatttatgagatagttggacaataaccaaaacatcagacctgggtaactgtaaacatatttgagtctcagagtacttttaccaagaacagtggacaggaggaaaaacacgagcatacagaaaatgcatacatacatccatttacctgaaatgttcttgattttagttatctttacagctgaatagtattccatagtacatatgagctaaattttctttatcaatccttcactgaagggtacccaggttctttttcattccctacttattataaatagagcggcatttaacatgggtgagcaagggtatttggagtaggctattaagtctagtccatggggcatatgccaaggagtggtatacatgaatcatatggtagattgtttttacttttttgataattgataatttttaacagtgatttccatagtgcctacactgttttgcactcataccaacagagaatgggggttcatatgcatgactgattggcttagaactattggtaaataatctgtcttatcctttatttgtgtgatacattcctcagctaaaattgactataagtatgagccttatcctgggttgataattacattttattgatctttctataaaactatatgtataacacactagccttattaaatttacagtaaaatttatagtaaagctttttttttagtctccatagcattatgatctagtcttaatccttgatgttaaatgtgaatattagggcagttcataaattcagggtggaaacatattgaagttaaattgtgtataattaaattgaatttaaagatttatttggaggatcaatgcacttttacaaatcagtagtctcatcatatatgcatgtatgtgtgaatgcatatatttaagcctttctagcagtctttttatattttcaaaaaggtttagatgtgcttttattcaatttatcagattcaagtttcctattgtataaattagaaataattcttccatcactactttccacagttggttttaggctacgttgaaatgataattatggaataattacataaatgataagatttttttcagggacgttgagttatttttaacctgcggtaggtgcttaatgaaatttgggggttctttgagcttctatttaattattattctcctttttctggtgcaaaagttaagatcttataattatttaaagtaattgctatttttcaacattaggaaaactattgttatgtttaattatttctacaaggcttagccaaccatggctttccatttatctactgttgtcttgaattaatgagggatatgaaataacatttcaacaattattcattatattatagcattgaatcaagtttgagatgattatttttgttttaggagaaaaactgaaattcaataaagcattttagaagcctgatacttgatttaaatgtgtgtgtgtgtgttgcctgtatgtatctgcaaggtgtgcatatagtgtctacagaaacaaatgtttgttttctgcatttttttcattttgttttggcattttttgtgtgattggttttatttatttacttatgtttagtttgtatggttttattttttttagaaagtacgtgaaaatggatgagtaggaaagtggtaataatttatgagaagttggagaaaggatgtgatacaaacttttaaaaatttaaaaaatttttatattatgtatatatttttctgtatgtttttatgtgtagcatgtttctgaagtgaccatggagactatcagagggcattggatctccaggaactagacttacagtcaattctgggctgctaggaaaaacaaacaaacaaacaaacaaacaaacaaacaaacttggatcctctaaaaggacagccagagccgttgtctttcgcagcccctgatttttcttttctttctgtttttcctcttcattttgaaacagggtctcacactctgctggcctagaacttagggcttgaactcatagaacttggcttatccctccctcttaagtactgagatttaaggcatgtgccaccatacatagcttgatatatacatttgttatccttgagactattagactactgattgaataataacatttatgagcaaatttccttttaaggttttatctattgatgttattaacaagtaacttaaaatgtaatgtttgttttccttttggattcttttaagttgaccacttcaatcacttttcaaagagatgtaatattcacagcttgccaaatcagtaaaaaaaaaaaaaatcgccttcttttgctatgttttcatcagtatattatctgaaaactaaattgagataagaaaatattcacttgagtgaatttaaaaatataaatgatcgtgacatgaaattaaaattttagcaaaaattttatgaagaaaatataacttttaagagatgacatcatatatatccagccagcatattaattaataaatacttttggagtaggagaagaaataacttactctagagaacagataaaaatattataatagattaaaatacagacttattcccactggaggagataattattaggtacaaatctgaaattctaacatggtttttcataaagttctattctataaaagcaaatatttatgttgttttgtgatgaattagtttccaatagtcatatatatgtgatacattggaaaagtatttaatagatgcatagacaatatgaataaaagatgtttcttattttaaaagcaagattgtttcttgcatattctatcagtctattgtgtcaaaacatgagaatcacttttgaaagagggatattcatgaatcaaactgtattctgatataagcttttaggttgatgaaagaagtgaccaccctataatgaaaagagtcaaggataaaccctgacaacagaaaggtagtacaatgtttaaatgaagttcaacacttaagtggttgtcatatggaaacaaatgaagtataacacatttcatggggagggagcaactcttaatagacaggttctatttcaaagaagattattgacactcaagttatttaaacatgagaacattctactgtgcttagtagaggaacttgtgctctgagaggaatgaaatagatgattctatctaacttagtatttataaaatatttacagtatcctaattgttgaggtttatttgttcttaattatcaccagttcttagtagtatgtcattctagattttaatctacatggaatatctttcttggggcctgtggataaaggttgtcagtaagcctgacaaccagaatttgattcctggaaccaatgtgatagaaggagaaaaacaattacagcaagttgttctctgacctccacttcaagctgtggcactccctcctccccttctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcccctacccacccactcccacttcttgaccctggtgttcccctgtactgaggcatataaagtttgcaagaccaatgggcctctctttccactgatggccggctaggccatcttctgatacatatgcagctagagacacgagctctgggggtactggttagttcatattgttatccctcctatagggttgcagatcctttagttccttggatattttctctagctccttcattgggggcccaaatatttcttatagttacttaattcatattaatttttaaatttttgtttatatctatgtgagcgcttacttgtttataaagccattgtgtttgtagggcattggatcctaatgagcaatatttatacacagttgcgagccagttgacatgggttctgagaactgaaatgcaaagtgtgttcttaaatactgagtcatttatctactcccatatatacatttttttaaaacttcatcgagtttcctaccaagtaatgaatttcatcacagcattattttatatacaatatatacaaacttcataacaaagttgtagtaattatatataatataataataatataataataatattatatatataaatatatatatttgaatttataagtcatctctatgaagtaggataagtaaccaaaaaacagagacaagaaaaacaagactattatgattttaaaatgagctcagtagttggatttatttggttttggttttggtttaatttctaatgcagagtgtgtaaaatgacctgatgaagtgatggctgaatagaagcaaagagctgaactattaggataagagttccaaagtaatttccagggctcactagagacctggtgaaccagaaacttcatggggtgaggggacatgagttccactttattcaaacttccagctaactgtaattcatgttcaagtcaaaccactggagtatactgctgggtaaagaagagcttagacaggatttctatggacataagttggaaagctattccttgtcaaagcacaatactagaaataaaagatgcagatcacataattttgagtagtcatgtggtttagtgattaacttatgaggtgaacagccctggggaactattaaaatagttttgaacttcttgtgttgaaaaataatattgagatatattttacaatgtttacatttatcatttcaaataataaaactgggtgcagctgcttgccagaaacaaggcctatttattttgtctcacagagaatgaatcctttcttcctctaaaacagtgttgggtaatgttccaaaaaagtaattacaggccagttagtaaatgcatgctgagacagtagaatgccagatagcagcagctatatgtctgctactgctgcctaatcagctatgcctgcttttattttattttataattttttttacttaatatgtaatagggactccattaaaaacagaatctgcattgcaattacaaaacattctttcactgttttcctaggtatttatgtattattttcttttcgtctgctgtctagtagaatgacaatcaggattgcacatttttacaaattgcttcttaacctcctgtcctcctgttttatttaaaaggcttgtcaagccatacaagcttatggaagtttagggagttaaacttcacagccaattcaatctcattttaatataaactgaacagcaaattcttttattgtagcagtttatcactttggacccaaattacagaaaagtagttaggagatcccataacaaaaatagaagagtccatttgtggaggcatttcctacagtttgctatatagctctctgctctagcacattttatatagcactttaatataatggtttggatgaagatagaccatgatcttctgggctttctgatttttccttcctattcttaattgcgtaagctattaaaaacattttgaaatcagtgatttcacattccagcattatttgtatttagcatcaggaagaatgtgaaaaagctatatgtctggcaagggacagcttgtcattgactcacttcttgttgcttgtcctcttcttctgttgcaggcttattccaataattcatcttgccttaactgttgttataaggacttacccttgtattcagtaattagtttcaagctctgcttacatgtaaagctgtggctctctagtcatttttttaatgtagaaaattattgccataatttctagtcttgctgtttccctggacatctgccaaaagagatatcaaattattctgtttccagccgatctgatttgattctcctcaaacatgttagtacattcaatctaaaggatttgtgtgaaactctttttttggctattagtaagagtcttctattgtctattctataagttactattggtatatcattcaaatgtcgctggctttcatgtccaggaagatccctactgctagtaatattggattgtactttacacctataaccatcacaaaaggtctgctctagaggattctcttagactaaatgctagctttcatctgcacatctgaatctcacagagtacttactgaaacacacagctgctcttagaccctagtccttctgattcagttggtgcattgaccttgaattgatctgtttttttttttttctaacaattctcacagtaatactaatggtgttactctgaatactactggataaatctggttggttggttggctggtatgttgtttacatttatgttccagagctgctcactaatatcagatactctgacttagccttttttcttccatgtcttacttttcatactcttctaatcctatgagcacaattccaggaaaatatatgagcaaaatcaccacctcagacactgctaacgggtaacatgatgcttctatctgaggacctctgatatcaagtgtcttcagttcaacttactcaacaaactagtattgaatgctgtaggtggtatatgagagataattaccagtctattgctcaggcaactccaatcatttattcaagagtataaaaataaatgtgcaattacagcagcatgataatagtgctgagaatttcaggctagaaaacctttcatctgagctttgaaatataagttgaatttcatgggagaaagattttgaaatacaactgtgtaggcttgaaatgtattgaagacatatttttagagatagcaatgaagaagtgtaggaagcagaattgcacagatagagaggattggaaaatgctcagttgaaccaatagacatgaaacatccctttaaaattgggcataattaaggaaaaagatcaatcattcaacatagacttcccagcaagaggagcataatattggagaaataagcctagtaaactgaggaatgttcaaagaagatacatacaatatacacataataaatcacttacagtagatatttggaatcatctcaataatatacactggcttccagccaagtagccattgatcctactgaacccaacaggaaatttaactgtatcctctcttaagtattacatttcctcaatatcacaaatgctaaatgcaagataaatttgaaattgtgatttttctcaaaaaaaaaaaaaaatactgtaaccagaccggaaaaagttccagaccttgttgaaatgactttgaggagcaatgcagcaggtaacaaatctgccaacaagcaacaagcttcagaataaacatgtgtgggcccagagttcagaggctaaagtcaattgaataagaaagctatcactagtattttttacataaattaaatatgttgcaagtagcggaagtcacaacctaatggtaaatggtctgcctgaagagtggaaagtttattttatgctcttctcaggctcacctaaagatgaatgtgaattatttgtattgaacagaattctgttcactgtgttctaacgtgtagtgacaaaacttaagaatatataataaaagctaattcatctgaatgcaaatgcaggtattttgtgctacaactattccaaatattgatttttttctatcaaagtaacaatagcacatagttggtaaaagggtattataatctgaatgaataaaaaagtagactattaataattcttcaaaaggttaattgcacactgttattgtgacagaaagataagtcactgcgtgcttactatggtggtttgaataagaaaggccctcataggcccatatatttaaatgtttagtctcagggaatggcattatttaaggaggtttagaaggattaggtggtatggccttgttggaagaagtgtgtcactatgggtagattttgaggtgtcaaaacccacaccagggccagagttgttctcccagcctgtagatcaggatataacacttgctattgctccagcaccgtgagtgctactaagctgctgcaatgatgataagagaatctcttaatcctctgaatccataaacaaccccctattaagtgatttctcttacacgattcaccttagtcatagtgtttcttcatagtaacagaacagtaactcagagtaaatgttacaaaacctacaatttctatagtctacataaagtaccaggatcgatccacacactacacacatacacacatacacactcatacatgcatgcacatataaaagtcacaacataattaaatatgcccacatctatctttacagtagttgaattttatcctgatagaacagcttttgacaatattatgagtctgtatgaaagaatagcagatttggcctctagaaactatctaccctctgaaatgtcatgttttaaagttacctcatagtaaaactagtggcgatcaaggattgggaatgtggttagataaatgaaaatatggctccacttctaagatattttgcctttctacattattcaaacattctgctaaagaaaagataatgcaaaactctagtatccaaattattatagaacaataagccatttttaggtccctggactctagttcaaggttttgcaaactaaaattttagggcaaaatgcagacactcatttttataaacacaatattattggaccacagccataattgtgtatatacattgtcataactattttttagctatagaagcataattgaggagtgcaacagagacaatatgaagcacgatgccaacatctattcttcccagttcagcttcccagtcccctgtctttggaaagtccaagtcagtaaggatgcatgagacccagaaacttatgtgcttaggaaacactagaacatttagtaaacacatgcctagtaatttggccttctgattcctttgcatgcaagtgtttacattcatcaagttcatattcctttctttaagttcttctcctcccccaaataccaatgcaatgtgcaaaattgccatggctgagaatggctagagtcagaacttgtcttaattagtagagttagaggtaattaccctcaagtagaaaaaagcaggacaagaaaggagagaacagttaagtagtgtattctcaggtggagacatgcttcagtgtgattttcagagggacctgaaaatatggtgttgaggtatgaggctttttggactcacttctaacccccatgctgtcagtcatgtgaaagtatgtccccttaaataggggacagccaggagctattagcagcaatgtctatgagcacatatgcaacccacaacaatcagtaaatgtacaacatgcagtacagggcttaaaaatctgaaatgaataaaatataaagggcattttatgcaatagcccttaagtaacttaaggggctggtgaaatttctcagcaaaaccactggcttctcttcaataggacccaggtttaattcttggcactcacataaaattcacaactgtctgtaactccagttccaggggaatctaacaccctcacaccaacacacatgcaggcaaaacagcaatgcaattgaaataaaaataaataaataattaattatatatttttaaaaagtatcaaggtatgtttccaaattagcacattttggaagtaataaatgcatcttctgagattaaacgtcaagcattctatgacaagtgaaagtgtatgtcagaaaaaagttacttttctatttattaaacagtcttttatttttgatcagtgtcattgataaggtacttggttactaagatggtttggctacagtaatcgctgtgatactgacaggagagtcttaggaacagcacatatgaaagttttaggcccacttgcaatggtactgctgccagatagcccattcccaagattctctaatttttcaaaggacgcttaaggaatataaaatattattacactctccatacttagtttactttctaaagaatcatcgctaccactgattgagtaattctccccaaatgcaagtggacatccattcttcaatctttatgcaaagtcacagtcacgtggttgaatgttgctgaagttatttcaactcacattatgactttgttactagtgtataccacatatttgaattacatctgtgtattttgttcttgagtatataaggagtatataatgttatggatagagcatttattttaacgattttcaacagactggaaggaatgaacctcttagaggtttcagtgtggctatatatcagtatatttctacatcactaaatattttctttaaataactctttctttaaaaatgagttagagtagtgattctttattcataattttagcatctgtgttaatttgcattttattgctgtgataaaacactgacaaaacctgacttggaaaaggaaagggtttttttggttggtttggtttggtttttgttcatttatttgtttggttttgttttgatttttgttttgttttgttttgttttgttttattttatctccaatgttccaatctcaatctgtcactagagaaaccaaggcaggaactcaagcagggcaagaacctggaggctggaactgaagcagagagcacagacagaaagttgcttacaggcttgctcctcctagctttctgagtttgctttttatacagtttaaaactacctgccaggggtagcactacccatagcaggcagggccttttcacatcaatctaatcaagaaaacagccccagaaacttgcctagcagtcaatctgatctcaatagatactccatattcctagatgaggttctgttttatggcaagttgccaataacaaaacaataacaacaacaacaataagacagcatgctagggctagtttcagtatcaactataataaaatgattaaatggaaattttcccaaatcaataatttgtaagttttcagctgtacatcattctggacagtacacattcaggctatttgctgcccagtaggtgtgtatactgggaaaatggagacaggaagatccacagatttggatgctcagccagccaatctagctgaatcactgaactctaggttctgaacacaaacacacacatacacatacacacacacacacaccacacacacacacacacacacacacacacacacacacacacatacacacacacgtaagaaatcaaatgtaaggtattcttgtcctctcattagacattccagtctaatcgctagagaagagattaaaggcagtaaaattttctctgatggccagtattattataaggcaatacattgtcaaagacaaatctgaagccagtgcatgtttgggagaaaatttgaatgttcctcagccttgggtagagtatcagttatatcttaaacttctgcttcacattctatttaaaggaaaaagtgtagggtagtaggctgcaaggtcgtccatgtgatatttaattatttaggctctcccgaaagacctaggtcaaatcttaacactactaaatattaagagctcacaaataaatttcattaactctttaggcctctaattaaaaaaaataatacgacaggatatattttgatttacagttccagggagatagagtccactacggcaaggaagacatggcatggtggtagtagccagaagttggctaatcacacttaagctctaaacaggaaggagaatggtaacaggaaatgggcaaggcaataaaccttctaatttcatcctgcaacaatatacttcttccaacagcaggcctgtacttcttagccaaataaaacttaatatgaaaattgcatctctaactttaaaagtcctcaattcacaataactcaaaatgttttctgttcagatatgatgccacatcttaaaatttctatgttatgaaaatgaacaaaattactaaaataattactaaaacctgcccaagttatatgcatgtggtgtggctcctatctgaatttgcttttcaccttcatgatacctcattttccatcaataaatattccaaaatctaaaagataaaaacttaattctaaaacatttctgaacccaaacacttcatgtacagaatgtttagctagtttttatataaccgattattgtttaaaaagtaaaagtacatgtgctcaagtatttcctagtaccgtatacatactaagaatcagaagatattcactgttagtatctttactaatttcccaattcacttaaagtatcaaaaaagattttaataaactaaaagtcggattcagataagtgggcattatcaagaacagttctctaaaaattaataattttgatagaatttttttttttacttagagtgagaaatcaatttcagttgtaaagattccatatgtagtagatgtacttcattcttgcaaattatggtgatactgaagtttgtaagttaaaggaaaagcttcccaggccacacattcataagacaaaggcagtggccttgagcattatgtcccttgctttatcaaagaatacacttgttttctagattttgatgagcttgccaactggaagaacacataattagatttaaaagcagattgttccacaacactactctctttcatttgaactgtcattaattgaaataattctgtgtctccaatattccattatatctttcatgtagccttgtggtcagtgggccattgctaatcctttccattagggcaactagttctctcatttcatgcccataaaatgttccttggtaacatccaactagaatttctttttccagtacatgagtatgtgtctgtctctgtgtatatacaatcacaaatatgctatcaatctatactcatgtctatagacacacactagatgataaacacacactgtgtttatacagtgattctgctgtacataaacggaattgacagaattgaggaatgttccaaataaaaaatatttccctgaatctcctctcctctctctctctctctctctctctctctctctctctctctctctctctctctctctctctcttttctctctccctctctcttcctttcataactttctagcaccttttcctgctacctgaatcatacgaaatcaatatatcctggtaacatgactgagataaataccccaatctcagtaatggtagatttgagaccagtaaacacacaaacactattggtgggaatgcaaaaagtactgaatcaataagcagcaatggaaagaaaaatctttgagtgttattttagattaataatacatttggggtgacttccccagatcctttagattcagcttccagtttataatgagaaaccaatatttatacatagtttgtaccattagtctgaagaattctttcgttgactctaaaataaaaatcaactagctatcaatgtagctaacacagtttccttactttgtttcctcagttattctacatcatactgaacatataaatggtcttttacaaagtacatgggcgagaacacaatctggctctcaaaattttacctcatcaacaatggagtgtgtgggaaagaatggaattcagtagtgggttgatgtgtagatattaaacaaagccttcatcatctggtgtgtctatcagagacacagtcattgatagtagctccagtctatctggtgttgggtccatcatgctttgcatagccatgttgttcagaactaaataactatttttactgctataattttgctatgggctatctggttatcttcagacaaaggaaaatgtcttatagcaacaggattttgtacaattctattccttattcaaagaagagtaaggatttacatccattcacattgagggagaaaagaagctttaaaaggttttatgccaccctctctttaccctcagcactttctgtgtatgaaatagtaccaaatggtgacaactgttaaggatttgaaaaagatactttcttcttcatgtgtgtcatgtaaatgtgaaaggaaaaatccctctgggtaaattagcacttcgaggatttagcaaaggtgaattaactgtgacaaagtcccttaacatctttaactgatgatcttgcaagtcttttggctgatcacctaggatactacaatgctctgggattccactgagtcattaaaatgtaagacagattctctgggagagaaaaacaaatgaatgttgacttatagacagtatggcttgctaaacagcattctctttggctgaccacggggtgcctgatttctcttgcctgctcatttgacaaacagctgacagaatgtcagctgcaaaacctccaagaaatattgcagagacactttacaagcaattaccaaatgtgcttccccaaactgaatccataaatatcattttagatgtgtatattgttgctataatctagcttttgttttttcattgtggaaagaaaaaaaaaaaacagagagtagatacctgtgatgattatacttagaaaaaataccaagccctccgctctccttactctcaattcagactaaaatagtcctaaatcacacacacacacacacaccacacacacacaccttagtgatggcagattcaaaacaacttgtgactgaaatctacctgactgattgtgaaatatccatctttctttaccttcttttacctaacttgatgtcactctttatatgattcacaacaggagaaaagtcagcatatttaatcacaaagttgcttagtctctactgaatatagtacagaatgtgtatcttattaattaaaaaatcttacattcagaattttgtaacagttaattttaaatgttgcaatacatagtctttaatgtatatttcacattgaggtatggtgctaactgccctacaaactttatttcattaaacctcacaacatcctttgaaaatagacattgctgtgacctttagtttacagatgaggaaaataaggatttggagaggtaaaataaatggtagcttttgtccctcattgttgcataataaccaccttgaaataaagtgatataaaaaatgctttacagtcaatgaacacaattctgtgacttgactcagctcagctgaatggctacatatgttttgttgtttgtttctttgtttgttttgtcaaacaggagatgggattataattatctgtggattgatgtttggctcaaatctctaggcttcagtaggaacaccacagacaaagttggcatccgtctctccacttgttgacataagtgtttagtatggcagcttcagtatagtcacacccctatggcatctgacatgccctactagagtatatgttccagaaactggccttataaactatcaccatgtcacttccatttatgtttttccctggattgagaaagaaagattacattgatgacagactaggctgcttggttctgtgaaggttctatgccccagtgtaggggaatgccaggaattggtgggctggggagcagggggaggtggggagaggatatgggatttttggaggggaaactaagaaacgggataacatttgaaatgcaaataaagaaagcatctaatttaaaatggaataataaaagcaaagaaaatggaagaaaaagatgtaaaattcagaaattaaagggaaaccaaatgagtgcaagccccaagggcacacatccccaagggcacacatccccaagggcacacattcctaagggcacacattcctaagggcacacatccccaagggcacacatccaatattctgagcatatcctaaaacatatcttctgccaacagttccactatctaccaatagtgctaccctgaggacaaagacacagaattttgggcaactcaatattcaaaccacattcataagtgacatctaaaatagattttagatgtacttgatgcaatcaatgttcattcacaatggagcaaagtcatctctcactaataattttctcagtgtagtatcttagcttataatcttctgttgtttaatattccattcttgcacaggcacacacacacacacacacacacacacacacacacacacacactgtggaggtgtcaaaatggagatggatggttaatttggaagaatgaataggtgagtttttcctctcttattctaattttagtgattctaattcaccatttttaactcactttaagcacttttaaaaattccattcatttattttgtggggatggcagtgcacatgacacaacacatctatggatacaattttggagagttgattctctccctctaccttgtggatcctagggctcagactcagattgctgggccatcttccagacccttagcctggtaagagaaaagcaggaaataacaaccaaaagagtcaaaaagggaagaaggaaggcacagagtacctttattcccaccttgtcttccctctacttaaaaactgcaatattaatatgctcattctataaatatttcattctgtaaacatttgctctggctactagtgcagtgactgatatacattacttcccatttctgcagcataaatacatgcacacagctccattagctggggggatatgcccctcagatagctcattaattaactgtctctcagtctgcccttcatccaccagaaaacaaaaaatgaaaaacagctgggtcatgctggttacatgacaaggttttaagcttggagaccagagttgtttttgtctttctgtgttaagcattgagccctagtaaacctggagacaaatagggagggcctagagaattgaggttctgtcctgatttgtggaggaataatcacacagtgctgctcaggaaagagttgatttagttgatgtttctttagggagaatcagagtttcgctgggatttagctaactggcagtcatggttctgaactccatccccatttggctaagactatggcatgtgtcaaaatgacatgtttttttttttcagggagctttgggagggaaactcacagctagcagctgtgctgataaaatccagctgactggtagctcagcacttcccgcattcctcaggggctcagagtacttatcttctgctttctgtctctctcaaccttcctcctgaatcctgacctttacagcagccctccttgccctgtgtgtacctactctcccaataccaagcaacctcttgtttaaaacagcaaaaaggaaaggagggagggagggagggagggaaaaacctatctccagagttctctcatttctcacaggttctaatatcatattaaaactgttcatgactcttcctagagaaacaagcaccactctggacaaccttcctgaattttatttaattcattagttgtaccaagtgcagacatgtctattctgttttgttttgttttgttttttgtttgttttttgtttttttttttttttttttttgaggcaggtgggtctcagctctccttttttagtgctaacctagctaaaaacattctaaagaatcatcaccccaaacacacacacacacacacacacacacacacacacacacacaattaggcaaaaagctagttgtcttaccagtaactgaactgctatgcctcagtgtaggaaggccactaagatcacctcatctaattgccctcgttttatcagctagaaaattggaagccagatgataaagccatcttcccagagaccttcagctacaatgtaacccacgccacattcttcttagttcagctgcctttttgtaatactgttttcatagcagaactcatttgcctgtcacagtgttctgaatagtttagtttgtcccatgcttatacatgtatatgtcttatcatgttgtctcttcgaagtaatttttaaattgttagtttccatttaaaagtatgttggccaagagagctttccttgatttcatttagatagtagcatgttcattcttttttaaaatatttattgtttttaatttcatacttatgaatgtttgtttgcctacatgtatgtctgtgtgcctaggaagaaagacataagaggttgtcagttccatgggagttagttacagatggttgttaaccaccacttaggtgttagaaattgaacccaggtactctgaaaaagctgtcagtgttataaactactaaaccatctcttcaatgttataaactactaaaccatctctccagccccatgacgacatgtgcttcttggtctctgttcttattgggtgactgatcccatgttaccaggacaacttacatatgttttgacgacggataaaaaggaaaggaataacatggtgtctggaaatcatcatacagcatcactatgtcttttgggaatttacactctcagcacaaaatattattatataagcaataggtggtattccatactctgtgggtgcttgtaaatataactacaggttagaaggacccggaattactttgtatgcccttattaagtctattctagaattccactgctggctcatgtatcaaaggcatccaatgtgattagatacacacacctcacctgctcaaggtctaaagagtcaatggcaatgtcttcagctcagatgtgtcccctgttgggttttgagacaaggttcctctaaaaacagagttagggaaaaagttatgcccttggcactgaacttcattttaacctaaaagccttgcctttctgaataaaagaacttgaagctaatgttctggtttgtttaggaagtgtgggatctgggatcaagcagttgctcatgtgttctgtctcagaacattgctgaggattccattgagcaatttgaacctggagaagtacaaaccccctttgcatacttgataaaaacttaagatggccatcaaggttctacttttatgaaattgcaagttatttagagaccaagagccgaggaaggagcttgaaacaaagcccaggaggaaactttctccacaaatagagcctgagaacactgaagtggaacaacctatcttcctggtcatctgaagatccttgaattacttcagctcatgaatcaaatacaaagggagacacaaagactattaatcactgaagccatataattttgttgtcttgtagtcttctaaataattcagtctcttgtatatttactatcttgacaataactagtatagtacatttataaataaaagacaacaaatgttttaaatagatcaaactaacaagtgcagtcacttgagtaatactgtatattagaatgatatttttcttccttggaagtaattcacaagaggatagaactgttgttttcttacacttgtaaccactcaaaaacttgtaactgttgatagtcacattaataaaaaatatggtaaaaataatttatatgatcataattttacaccattttaattattatctcataatatgctagtgatacaatgaaaatgcctcatttgtagttctatactcttcaaaatctggcagtagtcctattcttaaccactaatccatagtacttctctttgatccaaatctctgtagcttaactctatcaaattaatgaataagcatggtatggaagagcacatgttcctgccttaatatactatccactgcctttggtcatatctgatcagtttttatttgttctataaactccacttgatttgattctgcttattctaggatatagtctagttttgtatctttctgatgtatttcttatatgagttcatgatgcagaatgactctttagctaacctcacttatatttctcctgtgttatctgtctgcttttattttatcaaggctcaatgatggtatctttcaagaccaaatttttagcttctttttagctatgagcacaagtgttttttaaccaccttcctggccgtgattttgcaaacaacatttcttatttaccttgcatttaatattccatgctatgtctttcatgtaacattttatgaagccaccatttgtagtaaaatgatcagggaaaaaggggacgagaacaaaagtcacgagaaagaagagaagagaatacaaacacaaaaactgttttctatatgtcttattctgccatctggaaaaatgaattactttccctctgaggcctcccctaggactttgaagttcttattacaagcaatcaaagcatccatatcactgtgtatcatttcattttcttcttgaacactttctccattcttcttgactgcaaaggctttaaaaaataaagaatcttttcatttctcagtatccccaggttctggcatagttcttggctccagaaattgttcaatatatgtttattgagtatataacaggtaaaaatatgtccagaaatttaaagcagtcatatacattaattgttcttattgaagtcattttaagacttagtttcactctttgattcatatttttgaccttcagaactttttatgtgactacccttagtcatatttttattatgcatttctccaactgacttcctgcaaataacctgcagctttatttaaatacaaatcagatcatagttaatataattaaaaactctccatgaaatacaataagatcccattggggtaccacaaaacacaattatactttcatggcatatgctcttttaaagcaaatgcattcctgaattccaaagcctgacaatcctttctcatttctatcaacctatgaatatcatatacccaataattattaagaaaggattatattatctcaatcctgagttatttctctaagcagaatcatcaatagtgatatcagggtttatttgagtttaatgataaatcggttatattagtacaaaggttcatgataatcactctttttaaaaagatgatgaaatttgacagtatgtatttggtaaaagcagatctaggactacaagacctattcctttctatacaaaatctaacaggtttgattactgtgtggcatactcattcagactttcatggtcattgctagggtaattgcctacattataatttaaaagatttgaatactcataaaactgtctgaaacattattattgattcttatttttcttcttcacagaaggaatgggcacaggaagaaagacgagggtattggtagttgaaaaatagagatgagacttacacattgtttttcagtttaagaggctaaaaagacggtttcattcagacatcacagattcatgactatgtaaagaaacaaagaaaagtgccttaaagaataatgtgtatgtgggttgtatatgcatatattcacacttaaacacatgcaactatatgctacagatgtcttgcattaaagtatattgtcacagcagtgaccaattatgatcaacactagtgcagaatacagtaaaatgacccaataactaattctagcctcacagcttgagagcatgctgtctttcagtctttcaggataaaaaagatatgtgaggcaatatttggtagattaaagaatatggaaattcacttgtgtgtatagtcaattctttccaaggacatattttcccttaatgatgcaagttcccattaatgacttaaccatttgaatacctctccattcaactgaccatgagtcttgtcaatataaatgtggcttcagtcagaaaagagcaagctgccgctgccttttctttcactttttacttgtcaacatcatcaaaagctatagggttgaacagagagaattataatgtaagaatgggaagtcagaagttatgtaagattctcaggggaaagcaatgtatacttaacctttcacagggtactcccagtggccatatcctcctttactctttttgatacacattctttacagttgaatcgttcttctaaagtgaattctcttttctaagacaactgtttttattttttattcatgatacaagaatataccacagactttaaaagaattctgccaaggtattttacagttctaaggattggaagtcaggaatataatatattgggctaccatctagttgctgatgagttattgttactttctcagaactctagtggtgaatttacttctttgccttttctaaattctgcaggttttcaccactacttgtcctatgtccacttccttcatcttcaaagctatgttgtcaaattgactctgtctcacactacatacctttgcagataagagatgcatgtggctgttgtcttataaggacatctataattacatcaagatgaacgagataacacaggatatttgctctattttcttcatttatttttttgagaatttcatataaaagtactgtatttaccccattataattaaccaggaggaagaaaatctttctaaatggtgacattattcacacacacacacacacacacacacacacacacatacacacacaaagagagagagagagtcctaatttgttcatgataactcattgagaaagaaaacaatcatttttatcagaaaccaaagaacttatgctttactaatattcaaaatgtttcttgacacatgatcactcacttgatgtgttggccacttatttttcacatatgtcaattaaagagattgcatgagaaattttccaattatatatatatatatatatatatatacatatacatatatacatatatatgtatatgtatattgctactacatagaatcaaacttttagaggaaggcagaatagtttacatgaaaagtttggcaggatacaaggggaaagattatcacaaacaggatatctgacagagcaactctaatgtaggtcgtaggacatgctaccctaattcttgacattgaacattgttgggaatctagttctcccactaacctttgcatattacgtctctcctatagatgctcaatgatacatcagataaataaaatcagccagaaacatttcaatgaaatctttacaattatatatttctactttgtcttcagatttaagaacatgaacttcaaaaatggttataacaaagtccattttgtctgtgattcagggacatgaagcatgtcagaaatatatttatctcaacattaaatatgaaatcatttttataagtagctatagttagaaacatggttatagctagtgaaaaatgagttcatctaatagtaagtttcagctttatacagagtgaatctatagctacccttgcattgacttttaagcatatttatatgcattttaaagcaaatggctaaagaacttttgttctagaaggatgattattatatgggttagtagatttttacaacttccattctaacagaatgcaaaagcaaccttgagcatgttatcgttgagatcacagatactaacagatttagatttcaaagcaaatcttacctactgtctgttcattctcagcccacattcagacaagcccacagatgcactcagcatttatttaacctttttctgtgttttcttggaaataaattccagatcacaaaggagggggaaaaagtacccatgtcccacttcctacctcaaacacgttttcccatataggctttttatctacattaaatatattcacatatgcaggactggttccctatccatagcaacagcttctgtgaagctcactgaaatacacataggccccataatgctgtctttcagccaccaaggcagcctgagatgattctaaaggattctagcctgcatgtgagccattcttgtgactcattttcattgtattaccatctacactttagttctcacttctagtacagagagtaataataatatgagaaaactgagttgaaggattgttccattatttgtacctggaacaaaataataaatttttcctctgtaataagatgctatgtcagaaatttcctccgttatatcctgtaggaagagcttgttttaggaataatatttatattaaataatggaacatataatttggtcaatctgtgattcatattgattgacagctagacaggattcagagtcactgtggaaacatacatggcagtgggcatgtttcaagaaacatttaactcaacagagaagacccactctgaatatggatgacacgatatcatgggctcgggtcatggactgaataaaaaggagaaaatgagttgagcggaaacattaatctctttctgcttctttgggggatataaaatgtgactgggtgccttctgcatctatggtcacgacttctctggcatgctgaactgcatcccttcttaggttttaagacaaaataaaccattccttctttaagttgtctcttatcaggtatttggtcacagtgataagagaagtaattaatacacattctaacaggaaagataacaagtgacctgcacactgatagggttctcctatattaaatattttcatcttcacagatcagagaaaaccaattaggtaatgtttccctatttcatagtacagggaaggaaatttgtgaaaggttaattggagttctgactgacacataaggaagtctctagcccatattcttttttagttctcttacattatgttgtctcctacaaatgcattatcaaataggcaatgttactccttttctgagatagggatttactttgtagataaggcttacctagaacttactaataatttatccaggttagcctcaaatttaagcaaccttccagcttcaagttctcaaatgttgggattagaggcatgagctctgaattattcatttataatgatttatttcaacttattcaaaattatttttattttattgtcacctacaagtgaagatgttcaattatctttgaggaacctaaccaaattttattttttgttcaattttttagtatgttcctctttatgtatgttaatgttgaagattgcttcttagtgttggcagatgacttcaactttcttccaactggtagtagcatacccatgccatgtgtcttttaacttgatcatgatttgcaataaaagtgaagttttgtctatttatgtggtggtttgagtaggcatcacccctataaactcatgtgtttgaataattggtccatagagagtggcactgttaggagacatagccttgttggaataggtgtgggcttgctagaggaagtgtgctcctgtggaggcaggctttgaagttttatatatgatcaagtcacacgctgtgtgaaaatcagtctcctcctgctgctttctgatcaagatgtagaacgctcagttccttctccagcagcatgcttgcctgaatattgccatgcctcccaccatgatgataatggttcaaagttctgaaattgtaagctaactccaattatagagttgccttggtcatggtgtcttttcacagcaatacaactctaagataatttgcatgtttccttattaaagtaagaaatgattgtaagatatggtctcatagctttgtggtcatagctacacactagcaatctcattaggtttctgtgacttaaatgccatcttttaccatgcttcaacttacctaattcttttttaaagcagtattgatatcttttgtattagatatcttcttaatttacatttcaaatgctatcccgaaagtcctctataccctccccctgccctgctccccaattcacccactcctgcttccttaaccctggcattcccctttactggggcatataatcttcacaagaccaagggcttctcctccggatgatggccaactaggccatcttctgctgctagagacacaagctctgtgggtactagttagttcatattgttgttcctcctatagggttgcagaccccttcatctccttgggtactttttctagctcctccattaggggccctgtgttccattcaatagatgactgtgagcatccacttctgtatttgccaggcactggtttagcctcacaagagacagctatatcaggatcctgtcagcaaaatgttgctggcaaatgcaatagtgtctgtgtttggtggctgtgggatggatcccctggtgggacagtctctgggtggtcttttgttctgtctcagctccaaactttgtctctgtaactccaaaccaaatccaaaaacacatcaaaatgatcatccattttgatcaagtaggcttcatcccaggaatgcagggatggtttaatatacagaaatccatcaacataacccactatattaacaaactcaaagacaaacaccacacgatcatctcattagatgctgagaaagcatttgacaaaatctaacacccttcatgataaaagtcttggaaagagcatgaattcaaggcctatacctaagcataataaaatcaatatacagcaaaccagtagccaacatcaaactaaatggtgaaaagctggaagcaatcccactaaaatcggggactacctattcaatatagtacttgaagtcttagccagagcaattagacaacaaaaggagataaagtggatacaaattggaaaggaagacgtcaaatatcactatttgcagatgacctgatagtatatataagtgaccctataaattccatcttacctaattctaacgactgttctctagcagaataatgttagttatcttgaactataatggctctgtttatactcagcctcatctcatccacacattaaatgttccaagtgaggtactgggtgctttttcttttggagatcagctatgattcaggtatttagtctttcacctccataaaagttgctgttaaggagaccttgtgattcacacaaatgtctggaataatctgtgtttcccctccaccttcctaataaatacctgtctggatgccccagatcaacttatttacaaccacaactgctacctttctcctaaagttaaagaaaaagaaagccttctattcctcattgcatcattgtcttaaaaggactcttcagcttttgtccttaaatcttttctttacttattttcttgtatcctatgtcataaaactatagctgatactaatgtgtctgtttttattgccaccatgttacctgtgctgagactacattgtgtgaccttaatcagtctcttttcctagctccctcttcctctatccaccttctaagctactccactatttgttgatctatctcaccatttcacgtgtgcctttaacccatgagaagcatgcattattctgtcacaacactgaaaaacatccaaatttctttagttcagattcaaaaccatccctcccatgtgtgatttggcatataacaagatgagtgactgaaattcttcagaattctttattcttattttcattctgcttcttcagtgacttaggcctttgtaattgatatctagtattttataggtcataatgaataaaaatatattaattctagatctcaagcagaaatatgcaggagtctaaagagatattctgaagtagatttatatctgtattctttttgaaattctatcagattttccttgaaagagcaatgcatagattttataaaagttttaaaattttggcaattaaaattatcactttgctcattcatttatgtccctttgaataatagtcttttaaaaacccatatatttttctgaaactgaaaaatgcttgtctataaacaattatttcaactcatgtcaataatcattgtaaagtttttagtttgaaaataaaagacaaatatagcaagtattcttaatctagtaggtaccacatgtgaacacacacagacttcattgctgtcatttgaagcaacaattgctacgtttatttcaacaggattacctttttttttcctccagtaataaataaagacctaaagacctaaagtcaaacatatgcattttgcaagggagggaatcttagctgaagcaactctgaaaactacatatcactggaactgtctgtagacacagatacaggaagcaatgccccatgtctccttgctgacctcacacaacttcctaattactgtatagcattgatgcatctcagtcttctcaaaacactacacttcttttattctgggatcattttattttcacaaaggaggctgataaatgaaacagcttcaactattcatatcatagtactttttcgttattgcaaaactaggaagaaaactaactctattacaaagctgcccaaatactatgtgaagaataaaaggaaaatgtgtatgcatgctaagaagagaaataattatcttagattatactctttagtgttttataaatccacatataatgggaaaagtacattaaattgtaacggctactgaaaatgaaacaggagtataggtgaataagtactgatttcttttctttaggtaaatgaacatatttagattttagaatttctggtcaaattactgtattattagaacaaagatcagaactggattctatctggagctggagaaaactaagctacagtcataatttctactcctaaatccagtctgctgagggttaacactgtgaggtagttgaacaaaggactggctattaaaaatatctttaatataaaaatgtaggtattattaatgattatgtttaaagcaacaatcttccagaaaatgaagaagagaaaaaacaaaatcatacaatgggaaagtaagtgtacaaattgactctgagctatcataattcatctaaataaaatacatgacatttaattttcaatgattaataatagtaaatattcaatcaaacatcacaaagaactattcatttttggttaaagagattttaaacaatcttcattttttcatgtctttttccttgacttgacagcaaaaatggcatggtatctagaaagatttggaggtcagaggttctcagatttaaactccagttctgttgctttcttaagtgatctgtaacaaatcagctagtatttttgaccctttcccttcagcaaaagaatagaaaaatggtacacatgagtgattattttataaggatttatggcacatacaagtaattaatatttaaaataatgcttaagataatataatctaataagatatagtatggccatatgccatttatatgttctgttaatatatggtgtggtttgaattaaaatgccccccacataggttcaaatgcttaaacactggctcttcagctatgacactgttctggtagaatgtgaaacctctaggaggcaaagcatcactagaggaaatagatcactggggttagttgaggttttatagtcaagccccactttcagtttactttttgctgcctgactcagtgctttgtcaccagctacctcatgtttcaataatccaccatgcctttcctagcatgatggattatcctttcttaaactattagccagaagaatttttttaaagttgattcttgtcagtatgttggtcaaagcagccagagaagaaatcaacacaatatgctaataccatcttatcacaaaagcatataagttactttgaaaccatgcttttatatgtggaggtacagaaaagtactgtagttgctatgtcttagaactttacaacttaattcttcttaaccaaggttgttagactattgacaaattcagtgttgttgctttgtcatgtaattttctttagaaaatcaattgatgagatagtctgtatttctttttaaatattgtttatagtaaatgcctgtgttttatgcagttatagtaagcaagcattaattttcttttggaacagattgccaacatgcaggcacatagcaatagcaggaaagagcttgagttttaagctctttttctgaaaggtaatgaatagagcttttctcattagagcaaatgcttaaatgaatgaacattgcaagcacaggcattccatacattatcccatcaaacaccaccatcgctgcctcatgattggtgctgttgttcagcattattgattttttttcaacatttgagtttgtttgcaataagctgaaccagagcataaccttccactaattagaaaaaatgtatgagtattagcttgagaaagcaacagtgttcctgcttattgtctaacacaaactcggggtgatgctttgtttgattgctattgtttctttttcccccatgacaacactgttacatctgatgtaaaaccaggcagacaaccctcttaatatcacatgcccctattgaacaggaaagtcctacaaagatcattcttaaatggatgcaaaagcacatgttatcttacaatattgctttctcccatgatcctctgtatacctctgagcctttggctttctgttttacattctttaaaactaaagacttttaaaagtgttttttaattataaatttaggaattattctttgattgatacattctgtaaacattgctttgaaatcatactatattaagaagctaggaaatatatgtggatctctgtgtgtgtgtgtgtgtgtgtgtgtctgtgtgtgtgtgtgcacgcgtgtgcgtgcatgcatatgagtgattcacagtgtagccttctccaagttggtcagactaattgagttgacccatgtagatttctttagcttagtaatgctcaatcatggaagtatttccaattatataataaattaaaactgttcttcttcaacttattcacagtgattgaaagtttttttttttttaattttgaaatctgatagtgttccttcattgatttgcctaatttttatttttgaaacagggtctcagccaggctaacctaaaactcactgtgttcaggctcttctcccatctgcagcagtccttctgtgttagtctccttagtgctgagattattggcataacccactgtgcctgctcagcacgggtttagtcttgtcaaagtgagtttgggtcaccctcaggttatgtgccttctcaagaagtgaaactgccatgttccttattcttttgcttgttgacatgctataataattaatgtatcattattagacattattgtcagttacttaattacacataacagtcatattaataaatgattggtacagggcaacttttattttcttgatagagttgtttcttctctttctaaagtgagctcctcaggttgaaaagatgatagtacatttaaggacttgtagaactaaatagcactgtgtaaatcccagctagcatactgttaaagtgttctagccttaaaatcctaattgcctccttagaaattataataataaattttaaggagtttttgataactgcaaaatgaacttttgaaatattaatacattagcaaaacatatcttctggggaaattttatcgtaagaaagaatctggaaatttaataataagtataatttaatgaataattttctatggtgaatcactatttctttgctataaaaatactttttctctttatatattcatggagtgagtttctacaaaggaatccaaaatttgttaggaaaagaacctaaaggattcccaaaatgttcctagtttctagaccatttcctgcaatgtctgatagtatgttgagtaactggtttcaaaggattttgtaagaagagattgctagattaatctcatcccttattaatcatgaaacattatgttaaaataatacgtagcggggttggggatttagctcagtggtagagcgcttgcctagcaagcccaaggccctgggttcggtcctcagctccggaaaaaaaaataataatacatagcagtgaaccatcaaaatagtctcaattcactgatccagctaaagtactatgaatgtaataatcactcaataaacattttttgaagtcgtcaggattaattcatgatgggaatcagaatggaagccactaggaagtaaagcacagcacatggtattggccttaattgcatggctgttctacaactggaagtgatgaaagggctgagacagctcagtgctccagctgtttgagtgtggggataaaagtgtgctcctggttcttaatgcactatagatattttctgaagcagacacagcctaattatacctggagcagatgttataaatacgattctaaatatattgctgtagtgaatacaaacatttcatacagcagcagagcttcatatcagttaactgtaaatgcctaaagagtttgccaacaaagttgaaaatactattatactattgcacattacactcaaggcagtacctatttatgcattcatttaccatgagtgtaatattgatcgcattgaacttttgatcaattttcttccttatgcagtattacaggtcattatgaagattcttcacagtaacaatgaagtcattctgaatccacatagataccacaagtgaggggttgggacagtgagaagattcagcaggtaaaggcacttggttccaagcctgatgatgaattcagttcccagaacccaagtgatgaaaagagggaactgtctccagcagtttgtcactggcctccacatgcaggccatgacccatatttgtgttcacataaaataaatgaggtctggagtgatgcccctgtggctaagagtacatgttgctcttgcagagtaccaaagttcagttcctagagcttacattgagtggttcacagccacctgttactgcagctccaggcatctgatgccttcttctggttttagtactcatccataaatatgtgcacatacatatataagtacacatatgtgttttcaaacatgtatgtgtatatgcacaaacacatagtcatagaataaataaataaataaataaataaataaataaatgcaatacagttttaaaggattttgatgaaccatggaatgtaggtgatatttagagaactggaagtaaataatgttaatcccacagacatgaggaaaaagaccaccaacccaaattatgaccaaattctagcagactttattcgtgtatgtatcaaagcgagatcagcagctgtctcaccctaaggctgggtttatgagaccagccctgagccagtttctcaggctttttatagagcaataccatagtgtggaggattttgttagcgagcatgggtacaaaaacaaccccagccagttaaggtaatctttctggaacatttgtttctgaacattctatggttactgggatagggcacagcccaaccctaagaaacagaatcttaagacaaaaacttaacttacctacagactcaaaatggctcctgactataaaattgagttaggctgggttttcaatagactttaaaactatagcatcagttggtttccattcttaattggaactaattttaaaacacagaaccagagccacaccacccaggacaagagaactgagaacacacagaaatctgttggccaccagcagcaagggaagcttcctcttcccttatccttccttatatcttcctatatctagagacctgcctgcgccaatgctgtgggcgagaaaagatacccagaggactctcctgctgccactcgggactggtcggccatagatgcacagagccccacctggtgccaccccatggcagggcaggctgtaaataaacagatactcacccacagtcactccttgtcttgcaggcaggtggaggacacccagaaacctgcctgctgccacataaggcagtgcaggaagaggaagacatctagagacctgtcagttgccatgccatgatgtgcaggcagacacccagaggcctgcctagcaccatgccacatgtgaggtacatatagagggggttactcggtggctcactgatcacgtggcctgcctctagtggaagccactctggtgtgcaagtatcggtaagcacatggaagagaaaaagaagcaggacaatatgagcattatgaagaaagatggaactagagatgagagtggagaggaatagcctgtgttttaagtagccagccttgccagttgaggctatgtgaagtcacagccaacgctgccactgaagaccatgtttaggtctatcctaccagaggcaggggtcagtgtccatggctccctcctattatcactagaggccatgtgaaagttcatggtctggggagccacttggtatcacatagattactaaggtctttgcagaactggtcctgcccctcactggctgtggcactctggagagctagccccatgtttcactggctgcagcacttggtaaaacagaccccatgcatcaacagggaagaacagtgggtctggctttggtcgtatgggtgcaggtgagaaggccttgatggtgtgagggcaggagagctgaccttgtgacctggtggtggcagtgggagggatggatatctagggaagtgttgaagagctcaccctggtagtacaaaaaagggaaagcctgcgcactgaatagctcagttaccacccaggcccagatgcagtgctttgagtcagctcatcccaaaatctatcttatccgtgaactattggaggatgaaaaggggccagtcctgctgattcaatgtttcaggatctcgatgacacagagcaacaacaggataacctggaggagtcccagtgaggacccaatccaatattcatagtatagcagaagccagaggcctcgaaccagaccagtgattcattgcaatgaacatttgcaagtaaagaagtgtgaacagagaggaataacgtagaacacactggaacccactacaatttccatcatgagatgcttcgttttgttatttgttgttgttgtttatttattattttctgggagggaggatacaaagggactgggagatgagcaggacaggggtgcagtatgtaaaactcacaaaaaataaataaaaagttgaaaaaagcatagaaagagtagctttacatataaatagtaagttaaattatttcacaactaaggttacggtactaaagtcattttaaaaagaaacacatagccaggcagtggtggtgcacacacagagaaaccctgtctcgaaaaaccaaaaaaaaaaaaaaaatacatgcatttaccctcttataatcattcttctatttgccatcactgggaaatgtaatacctttcaaaggaaactagatcatttttagaaagagtttagaggcagagttttgctgtgattttttttcaccaaatttaaaagacaacattagtatttttatgtttagattttatcatttaacctatgaggatatatgttcacattcatatcacacagattgataatttgtccctctgagatttcttttgggaaataattttgtaattacccagaatagtattctgagctcttttcctggtcaaagtagaatttatattgccaatgaaatatgtagaccttaagttgtttcaaaattttatgtagtgtgcttgtgggtgtgagagagagggggggagagagagggaggnnnnnnnnnnnnnnnnnnnnagggagggagggagagagagagagagagagagagagagagagagagagagagagagaggtccaggaggccagaaaaggaaggcattagatcaccaggagatggaataataaacaaatataagacatttgaagtgaatgctgggatctgaacttaggttctctgggaaagcaacaagtactcctaatcactgacacatggcttcagcccccatgtgtaacgagtttgtaaaataaaatatagacttgaaaagtttgctccattatataatcaaaataaatttattctaatatttgtaaagtaatttgaatacctaatgatatattttcccaaatattatataagctttatttgaaaggagaggtagtacataaataactataataatttgctttctgtcataggagaatatgattaataaaaggacatgacagatcatgaagcaaatggtcaactacctagaagcaagaaggttcaaagttgtggatacattcaattttctaacttttttccccagaaggcatgttcatatctttttattgatagctggctttcagtttacatatgtaaagccaccattaatgaaacaaacaaatgactggttaataaggattgatttttatctcaaaagatacttaaaattcacgggatataagatgaatcaatagataaaggtgcttgcctccaagactgataatctgagtttgagtccccaacctctcctgctaacagaagaaactcccacaaattgtcctctgatcaccacctatgcattgtgtacctccccaacaaaatttttgaaatgtaaaaatcatagtttaaagatgtggtttggagttctgctttcttcctcaggtccaggtgccactgcaccacaggctgaaaggatgaagcagatctaggaatgtgtggggtctgcaggatcctggtccagctgggagtgaagggggaagagggctcagaggattttagggttatagctctcttagatgatcttcagtgaagcagctggtgtgcatatactttacttggggtggataaaagctatatatgaaccttgaagaatgaggagttttcagggtgaacgtaaatcattggctggagcttaacataccatgaacaccacatttgcatgaagaggcattccaaaaatcccaagtacttgctgggtaagattgggtaaggcagagaaaaagaagccttgctgaaaaagtgagtcctccactttgtacaattcacagaggtgctatccagacatggtagactgcaaccttaagtagcagggtttccccacatgaaaatatttaaaattcataattttgaaattgtttttcattattatattagtcattacaaacagttgttagtgttcataaaaggaaataaatatctagattttttgatgacatggtatttataaatttctacaaataattcaagttcagtatatgaattatgtttagcatattagactatgtaactctatttctataaatgtagcatcctaacatacctgctatatgataggtgctatttttcatgaggaagagatgatagaattagagccataatttaactaatctaacagatttgaaaaatgtatgtatcacttgcttgtatgtttcccattgggaaaagaagaagagagtggcttttcagaagtatatacatttaagtttaaattttagtaatgactttgaatggaccaaaatcaagtatttgttaaatctccacttgagaaggtaatttacctatttatttgtagtctctgctaattgctaagcatcaagtcaagtttatgctttattctaaagttattacaatgcgtgcatgtaaatatttttagaaacttaaatatatggattacaagagaaaataagaatgcaacactagattatagttgatgtttcaacaagtatgacctgagatgctcctatgtgatcaggaaaaattagtagtggtataaacaaatcatacataattgtttctaaaatttttagtcttcattgacaaaagacattaattaccataccctcaccaaaataaatacatgctcaatgccattgaatttcaaatatcctttcaagaatttttgaaacagtagcattaagtgggtgactttgctacagaacatggtagagccctcaaaactatcagaaaatcttttctaataccacaggattaagacagatactagagtaatgcaaaagtagtgcatattttgaaatgaaactcctttaacgaggagtgaaaggtccatttttctgtgggtataatgataggtatttttaatgaagttataaattatattggtacaataatcattaaataagaagagataatgacttgtagagcttagagggggacacaagaagacttggtcagaataggggtggaatgatagaaatgcagtattcatgtatggaattctcagtaatttgaaaaaacaaactttgaaaatgtggaaaatgcaaccctaaacacatatacaaaaactggttctatatatctaaaatgttcatacacattttaatataaatatttatcacttatgaaattcagtgcacaaagtatcacaagattaagacatgctaaacaaattcaccaagcaacatcattgtatcttgtttttaaataagtaagtgtctcagtgggacttatttatttgggagagctaaattaaagaggataggcacttacgtttcatcttaatttagaatcaatgtttgtttgactaatcttggccttgtgatcctttcacaccttgaagtttatcttacacccccaggtattttacattaattacaatttctcacacagttagcttacatagaaaagatacaatttttactaataaaattatcccctctatgggcaagtcattaactcttatcttttatctatttcatcctatgaaaaataagccactactttacttgatggtctcacactgatgagtgaagctacgtaatcaaaagtatgaatgagtccactgtatcttccttcagcatcattgtaacagttgggctcataaagtgagaccttataaaaaagaaggacggcttctctaaattcatatgttttactcaaaacctactggacaagattggtcaattaagttaagataaagtaattctagttcaagtagtctatctaaaacatcctaagcaactaaaaataacccgtaaacaaaattgtgggacacacagttattttaattatcaaccaaaagcaaagtaatctcaaatacgttgatgccttgctcaagcaggggtgtgtttatgaggtacttgcttcattacttatttgtcagcactgcagataaatatatacttgagtgcatgtcatctgaaaataattggcataccctagagagcgataggaaactgagatacacattagccctaccaaaatttaatgacttaaatctacttcaatgacttggcattctactccaataaatagtttggcatgtgatctatgaaaatcaatttttatagtattattacaacaaaggacatccttttatatgaaaagctttaatatctagttactgaaaggccttccatacgtctctcccactgagaactatttgttatctaatgtcacttatagactacatgtaaatcaaattattatttccagctccacatgctgcaatgctgattaaaaacttgtcaagctatcagaagaataaggccatttcccagcatggaatgatgttatttattctaggctcaatgactggtaccagaactgatgcttaataatattattggtgacccggggtgatggcagggaatcatttagaatggtctctcttatcacaatcctacagcactagaatttttgacaatattgaaataattgtataactttaaagaaatatatcagaaaaccataacactctcatggaattcactaaaggcagcaggtattgtgccgttcccagcacttatcccacatgaaagcatttaacactgttgatcactgtcctcttaaaatagtctatttattttctaacttttcctgtatttctttctctcctcactgactctttgcattctgacatcacagtaaatagtgtttcatcttgtgatttttcttgcattctctttttgtttctcttatgtttacctctccccacatattctctaggaaaggtctttgtcttgaccctcaagcacatacgcctgagacatcttccaccaattgctcagattctaattggataatttaatttttcttatcttttacctaaactaggtactccaaatatggggttctgaaattcacatattcgtgtggcaaaattcctaggaagcattcttcctcatagtcccgttcactaaaacaatgagtaagcttctcaaacactgctcaaatgtattctggaaatgcttttccctactgctttgcttttgttcccatcacttgtccattgccatcatttcaaaagagtctctgtttctctcttcattgacaccactgatccaggtgcctcagtttatgtactttattttaaagacttgattacatttctagccttcaactatattaacagtgtctaggtttaaaatgcaagagaatgccataaataacctttctagccattttttcttttttagagacagggtttctatgtgtagcctgggctgtcctggaactcactttatagaccaggctggcctcgaactcagaaatctgcctgcctctgcctcccaagtgctgggatcaaaggcatgtgccaccactgccccggcttagtcatatatttttattgcaaaaaaaaaaaagaatttttactgatcagaaatatgcacacacaaacatgcacagatgcacacacacataatcacatgctcacacacacacaatttatacacactcagaataaaaaaccataatatataaacaaagaccaaaaaagcccaaacaaagcaataagagccccctcttccccaaaaagaacaatctaaaaagacacccttgagttcattttgtgttggtcatcttactgttggggatgaggcctactcttaagtacagttaatataaccagtgagactttactggagagttttttttttcctttgccaatagatatcaattacagacaacccctcacttcgcgatgagagcacacgttcacttccccttctcagtgctggttttatattgccaggcttatggagtctgcttggggtctaataataaagacatggggacatctgtttgaggaaataacaaacatttacatatcctgctagcctggctccactggctctgccagtaatcattgagaacacagggacataatttttcagagtcagtaaatagaatatttgtgctgtatcccaaccagtttaacctaaacaggccttgtgcatgtgaccacagtctcagtctcgatgagttattatgtgacttggtcttatggtatctggaagacactggtttgcttgtttgttttgttttgtttttgtttttgcttatgtttttttttttttttttttttttggtgtcatctatcatctttggctcttaaaatctttttttttttttttcatttttttttaattaggtatttagctcatttacatttccaatgctataccaaaagtcccnnnnnnnnnnnnnnnnnnnntaatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttgggctcttaaaatctttctggctccaattccacagagtcccctaaaccctgagagaaagaacttgatgaacacgtccccatttagggctaagtattccaaagtctcttccccctgtacacattgtccacttgtgggtctctaagttagtttgcatatatcaaaagaagaagcttctctacctatagctgaccaaggaactgatgtgtatagcagaatgtcatcaggagtcattttatagctgtgttcctttagcataacaatagcatttggttttactttaagtccatggcttatgtagtttcaggttcttggccacccaaggagtatcaagcatgagttccatatctattcaaagagatgtttggttggatacgccgcaatgtttgtaccactattgcactcagtataccattcaggaatgggttacatctaattgaatcattgaccaaaggggccccatgatatactcccaaatatcccagtatattgccaaagctttttttaatttttttttggggggaggtttcgagacagggtttctctgtatagccctggctgtcctggaactcactctgtagaccaggctggccacaaactcaggaatccgcctgcctctgcctcccaagtgctgggattaaaggcatgaaccaccacgcccggcttgccaaagcttttttattggttgttctccacaaactggtggtaggggccattgctcaagataatattactaaatatttcattgaacatggaaaagtaaagctggtacctaactagagtcatcactcctactaactagtgttcatggtactgcaaggtaatctgcatagtaccagaggagaaagataactaccaacacagctacaaaacttgtgagtaacctttctggtcttagtccttggcttactcttttttttttttttttttttgtactccgtgtttcaaccagactgcattacaagtgaaaactagattattacactcctgtgtgtgcacatgaatctattttacatagttttgcagcttgtaatatatatatatatatatatatatattccaatattaatgtatacatcaatgcttatatgttatttcataatttttgtaggtgagtaatccatttgtatctaatatgggttttataattcagaatgtctaacaagcagcaataaaggtggcatattctcatcaaaaggctcaactcagaaaagttctacttgtagacgtaccaacaggtcatctgtccctgtttgctttctattcccatgatcaacaccatgattggaaacaacatggagaggaaagggtttacttagcttgcaggttatggtctatcatcaaaggaagggaaggctagagctcaagaaggaacctggaggcaggaacttaagcagaaatcaccgtgtggaatgttgcttactgacttgtttttcatggctttttttttttttatgattttttttggatttttttgtttgttttttaattaggttttattttcctcatttacatttccaatgctatcccaaaagtcccccataccctctcccccactcccctacccacccactcccactttttggccctggcattcccctgtactggggcatataaagttttcaagtccaatgggcctctctttccagtgatggctgactaggccatcttttcatacacatgcagctctgggtgtgtgtgtgtgggggggggtactggttagttcatattgttgttccacctacagggttgcagatccctatagctccttgggtactttctctagctcctccattgggggccttgtgatccatccaatagcttctttactattctttactggcttgcttgctttggcttgctcagccggctctcttggaaatcagtctggtggttcctcagaaaattggacatagtactaccggacgatccctcaatacctctcctgggcatatatctagaagatgttccaactggtaagaaggacacatgctccactatgttcatagcagccttatttataatagccagatgctggaaagaatccagatgtccctcaacagaggaatggatacagaaaatgtggtacatttacacaatggcgtactactcagctattaaaaagaatgaatttatgaaattcctaggcaaatggatggacctagagggtatcatcctgagtgaggtaacccaatcacaaaagaactcacatgatatgtattcactgataagtggatattagcccagaaacttagaatacccaagatacagtttgcaaaacacatgaaactcaagaagaacaaagaccaaaaatgtgtaggcactttgccccttcttagaattgggaacaaaactcccatggaaggagttacagaaacaaaatttggagctgaggcgaaaggatggaccatctagagattgccacacccggggatccatcacataatcagcctccaaacactgacaccattgcatataccagcaagattttgctgaaaggaccctgatatatctgtctcttgtgaggctatgccagtgcctggcaaacacagaagtggatgctcacagtcagctattggatggaacacagggcctgcaatggaggaacaagagaaagtacccaaggagctaaaggtgtctgcaaccctataagtggaacaacagtatgaactaaccagtacccccagagctcgtgtctctagctgcatatgtagcagaagatggcctagtagggtatcagtgcgaagagaggccccttggtcttgcaaactttatatgcctcagtataggggaacgccagggccaagaactgggagtgggtgggtaggggagttgggtgtcacccacacacacacacacacactttttcttttctttataatggcaaatatttaaaaattgtgcaaatggaaaatttagaggaaaatatgcttccatttttattttgcttcttttcttcctccatataattcctcccctgatcttactgccctcatacattactaatgttacagaggttaacagctttagaggtgatctaggaagcacctcctcttcttggtgtactttgggctctgcattttgttttcctggaaattctagaaaggtaaacatcagccttgcatctttttaagtattaaattatcatatggtggtagtatgatctggacttttttgatacccattaaaacaaagctacttcctcatgatcaaacaaacaatannnnnnnnnnnnnnnnnnnnaaactgggagtgggtgggtaggggagtgggtgtgggcgagggtattgtagcgttttgggatagcattggaaatgtaaatgaagaaaataccttaaaaaaagggaaaagggtaaagtggttgctataagtgatagtgccaagaaattaccaaaccagacaccccccctctctctctctatatatatatatatatatgaatatatgagtgaaagttagatttattaaggatctaactgctaaggcggcctttccatggagggcaaagcagagaagggtaaaattgcagaaaagcaagcaggtggtgatctggcctgtcactggttgcctggattgaatagatactaggtccctttcctagagataattgaccttctggggaaaattaagggaggttccttaatgatttatggtggtttcttgtataagggccacacaatcactgaagggaagaccctaggctcagctgctatgaaaagacaaaagagtgtttattttgcagaaaccaccagcatgcaaggggtcaacaactgtccaaaactgtgaccctagacaaaggcacacaggccttctcataaggaaccagtggaactttctagaagtattgggcaatctgtaatgtgattgttagggcaaaagcagtgatattagcataactttgattggctactaggttagttctatatttagagagtgggtttaggtaatctaaaatttcattggtgtgtgctggagaggtcacaagggtcagcttctgattggtttgtgtcaggtagtcagtggtcttcattctgatgccatgaacatttaactacagaatgagatagggctgcagaatgagatagaacatttaactacagatggcccattctgggataagatattttccaatccctatggttatccccaagctcttctttgggagggacttttatgtcattgtttctggattttatggtctgttcctggagctgctgtactatggcctagtttctgggacttgtggtctgtttctggaactggtgcctcatggctttccttttgaaattaggcctggtccttaaatggagacaaatggggtttgtgttgtcctttcacttgcaaagaggaaactgccttaggagagctgcttttctgattaacagaaacctgcctttaggcttatttcccaacaagagtcatttgtttatctcggccaaagttcttcagtttagagcaatatcaccaccaccattgacattaagcagagctggggtggggatttggacctaacatcccagccttttgtaaatgataaggtgtgatgagttctctggctacttcctgatgattgagggcttgaaaaaaagcaaggtctggaatgccagcttgagcctctgctttgaaccaatttccaatcttgccatgctgtctggaggtcaggaagacaaagagagcacccaaaaggagggggaggaagggacttttggaaccctgacaggtggatctaaatcatgtctccctagagcttgcatgaatcctttaaagttgacaaaagtgatcaatgttttatctctattattagcatgatcactgtctgcaatcagcactgaagacctcactgtagaaaaagcagttactaagttaaggtaaacatctcaaccaaattcataacttctagtcatagcaaaataaaacctaaaaagttatcaacatataaaaaaatgcatcagtaataagacacatatgctggcaggaaagagaacaaaagggaaagaagagtttgagtacccaaaagatggttctggaataaaaaggaacactttttgttttgtttcagacactgagacaaggggctaaggagcatactttacctaccaaagctgacctggcctccagatttctcccagtatccctcagtccttacctggcctaccctgaccactaccatgaactttccagcctaggggctgatttgtcctttcccccaggctgaggctctcttctcttctcttctcttctcttctcttctcttctcttctcttctcttctcttctcttctcttctcttctcttctcttctcttctctcttctcctctcttctcttctcttctcttctcttctcttctcttctcttctcttctcttctcttctctcttctcttctcttctcttctcttttctcttctcttctcttctnnnnnnnnnnnnnnnnnnnngccagtgaacttgcccacccaagagcagctttctgataaatcttcacccctctgtgtgtattattccggcttgaattggctcatttcactgagaaataactcatcactttccctctatccagatgtctgtgtatatatagattggacagaggtgttttcagcataatgagaaacacttttaaatctatatttagaaaacaacaaaaaacatttaaatttgagcctatgagtgtgtttttaaaaaatgtttagtagctagaccttgtgactattatcaagactagattaataacttatcagaactccattgtattatctttagatcttatttatacataccttcaatcacttcttaagacctccgcaatttaaactttattcttttcatctaaaaatacccagtcttttaatattagacataagtgtttctttactaagaaaatattgaaaagcaaggggttttattgttcttttttaaaactaaaggtatcaatagcatagtaatctgacttttttctctccattgaaacctgtttttgagtttacccttttcaccataaatatgtgagcatgtaaacctgtgtgtttacctatttcaacagaagacctagtagctccaggaatagcaaggcttattgtttttatttaagagactgggataatttaaggttttttttaaaatgttttaaaatttttatcatcagcaagtatcaaatccatcttttgcacctgaagttactataaagccagaacttttgactattgagatcagactttctagctatgaatggactgatctagtagctgcagcctaacaggagagactgactgatgttggcttgctgttgtcaaactctgatgaagataggacctgtcatcaatatcatgaagatctgaaaaagatacatttgatcaggaagtataaccaagaggcataagtattagttaaaatgacagaaacatatctgatacctggacagccaacctgggatcctctatggtgatcttgataactttattgggagcagatgttatcagtctttgtccaccacagagggtagcattaagtcttccactaccacaaggggaagcattagtctccagctgccagactcagatctgagagattttcatgtggaggaagaatttctgggaaccagcctactttggcatggtagaatagagcagtctacccagcagtgtgcacagtttgggcagagctctggcaatacacaaggcatagttctttacccagtggtcagccttaacacactcaaagtagataatggtggattcttcataggagatagccacaggactgccagaagctggtatttctgtccatcagagggagctttattcattaagcatcttaaattcagctgatctctctgtgggggaggttgagggttatcatgtaatctattgagtatacccgactttaaacaaactttactcaggtttatttacttgcttcagacttaaccttggtaacatatgtaaaaggctaaaagcatatgcttcataagttagtgagtggttctaaatctttgtgattctgtgactctaatacagtccctctaattctgaccatattaaccaacttgatcatttgtaaggtgtgtgtgtgaccattaacttgaataccttaattatctttaacagtttacaatgaattagtatgtttttagattaagattttacagttttatccctgttaagtttgagctttaaaattctgaattacatatttaattgaagatcccttaacatcaaaataagactattaacctttattacagtccacagagagactgagatccttacttttctgatccttacagcacattacactttcttgtatgactcatttggtacaaatagctaaagtttaagaaagttagcaaagacaaggaggctagacatacatcttcaactcagttactgttaatccgagtagatcttaggaacctataaatcatatttatcagacattcattatttattaaacatatttcttatctaaatttttctagaagactggtgttgattaactaccaaagtcataagaagttagacatacactgttaagtcagtttctgttaaccaccagaagagatcattataatattaggaacctcaatcagtaaacaaatataattttaagccctattttccataaaccttgttcatggttttgttctcatttgctgttttccacttccaggacaaaaattgccataaaaaaagaaatccttcttagtctaaaatacctttgaggcctactattgccttcttttaaaaagtaatcattttatttgtttaaatttcaaatgtccctcggcctggtctcccctccatgaaccttccaccccttcccctcccctttgcctctaagagggtgctccctaccctcctacccactctctactcacctctgtagcatcccattctctgatacaacaaacctccatagaaccaagggcctctcttcctattgatgtcctacaaggccatcctctgctacgtatgtggctggagccatgggtccctccatgagtactccttgattgatgatttagaccctggcagctctgaggcatctggttagttgatatagttgttcttcccataaggttgcagaccctttcagctccttcagtccttcccctaactcctccattggggacccccgtgctcagtccaatggttggttgcaagcatttacttctgtattctacaggtgctaggagaacctctcaggagagagccataccagactcctatctgcaacaatatcttggcatcagcatactattgcgttcttaatgtatggaaaataatgcatcatcttggaggcctagtgttgcttgctttgtccaagaaaaataaagtataaaaactatcttgaataaaataaatcatcttaaaatatctctacttttctaaatagtgaatctaagtatcatatatggttgttgcagcaaattaagataacatatatacatacatatatgtgtatatatattacatatatatatacatatatatttaaaactatatctatacatgtaacacacatgtatatgtacacacatatatttaaaactattaacccttcttgttacaaattttaaggtaactttttctgcttgaaattccacagatattttttgactacaccctaactattttaaaaaatctgaaataaagtttatctttcaacaaaaatttcaaagatatccatgaccttgaataggataggttttcttaaaccatgccccagtgatcttatagatcctgagacagagaaaagtttacatttcaacaagtttcaaacatagaaaaaaaaaaccaacaacaacaacaaatcccaaaagggaaaaggggaaaaaatcagataactgaacatatgtgattacactttgccatgtgtaacctctattggaaatcattgatattttagttgttctctagtacaaagtgtctttgtttctgtttggtctgttttgttctcctcttccttctccgagtcaggtggccagactgactcaggacagagactttcaaggaaacttttatacaaaaatgctcgagtctagggcaggccaaatcccaactctagggccagtttttttggtaaggcagaacagcatgtgacaatatttcagtatttctatactcaaaaagcatttgaatatttgcagaactgaatttagtgattagagggaggaactaaagcaagtggagagcaaaaatttttaagagcagagagaagagacagcttagagataattaattatgaataagagcccatggttagagacagagcaagctacagaagtgagaaagggagagagaggaggggaatgaagagcaagagatagatgcaaataatttccaagaggagagcatggaagaggtgagagagacttaggaaaaggtccataggattctagtgaggtaggaatagacacacaaggaaaggaagggttaagtgatttgttgaaagcgtctcaatctgagggtgtcaccaaatcataagagatttgtctgagggaatactcaggatcagtggaggagtgtccctctactactataggttagagagaagctgcctggcactccagtgtgaagtttgcagcagtggtctcttcagtcatctctccaggagtcaagagagacaggacccagtgagccaatgaggggttcagggatgggaataggggagagactgaggagaagcagccaaagatttcaactctgaaaacttggagtcaaatataatggatggtactaggctgttgaagaaagtgttctccacccaggatggtcaaaaattggcaacttggttcagttaggagggacaaggggccctttgggtggcccagtgtctctgctaggttttcaaactaaatgtaccacagagaaactactgaactagacagctctgtggggtttaaaaaaaaaagatttattggggatcaaactaccaatgctgtctcagggagtaggggcaaaaaggaaaatggcagaaaaacaagtgcatttttatttgacaacaacaaggtttatacaggctaattgcagtgatacaggctgtctggattcacacgaatctagatgtctttaccgaaggtagttgacttttatggaaatgttaaggatcgctcctgccaaacaggaacctttattaggaggtctgcctctctagtcaacagaaaccctctggtttggtttatctagcttgtttaacacataacaatccttctgtatactaagtgacatctcatcatcactgttatttgtgcaagtgggagggtgttggttggatctaacagttgtcagtttatacaattatctcttggtgaagttttaccttcaattcaatctgagctgttacttctctgactgactttggccaggaccaagaagaataagagagaaaaggaaaaggaaagcttatataggttcctactgatactttgtgggaactctgtgacttcactgatgtcttagtcagggtttctattcctgcacaaacatcatgaccaagaagcaagttggggaggaaagggtttattcggcttacatttccatactgctgttggtcaccaaaggatgcaggactggaactcaagcaggtcagaaagcaggagctgatgcagaggccatggagggatgttctttactggcttgcctcatctggcttgctcagcttgctctcttatagaacccaagactaccagcccagagatggtcccacccacaaggggcctttcccccttggtcactaattgagaaaatgccttacagttggatctcatggaggcatttcctcaactgaagctcctttctctgtggtaactccagctgtgtcaagttgacacaaaactagccagtacaactgaagaagaggatagtgggaaggaaaagtatattatctcattagagaggttattagtctttccattccttagcatgctttcagttgacgcagatttcctgagttggggtggggtgtagactcctccaaatgattgacagacatatctggattacctctgaagggaagaaacaataatgtgtaatgttctgggtagtttagaatgtcaatcaggtctccagacagagacagggttagaacttagattctaatttattttttgtttgctctattatttgttttatgtttgtttttgtttattgtttgtttgatcatgaggaagtagctttgttttaatgggtatcaaaaaagtccagatcatactaccaccatatgataatttaatacttaaaaagatgcaaggctgatgtttacctttctagaatttccaggaaaacaaaatgcagagcccaaagtacaccaagaagaggaggtgcttcctagatcacctctaaagctgttaacctctgtaacattagtaatgtatgagggcagtaagatcaggggaggaattatatggaggaagaaaagaagcaaaataaaaatggaagcatattttcctctaaattttccatttgcacaatttttaaatatttgccattataaagaaaagaaaaagtgtgtgtgtgtgtgtgtgcgtgtttgatgttattcagagttagttactgtttcttattgaaagagcaaaccattaatgttttccttctcagctaatgcaaaggtcaaacaacctgagaattacctgcatgtggaaatgtatcctggggttaataggaacaaagtgcccatctttgagttattttgacagctaaactctagagaccagagagaactaaaagacagtaaagaaataattatactggacactcatgtcaggaagggttaattaggcatcagtgggtcaaaacttattttgaagatgtggcattttagaaaaccacctagattgattcatattaccctcagacactcaaggtataattgctgtcattatcattttaatctgtgccctaatttagtggttatctgtgtagttgttttaaggtcttttcaggtgttgaagattttgatatttgaaatataacctgagaaaataattatgacatttcatatattggatattgccctttgcagttaatgacaatgttgctttaaaaacggttattgttgctagaacatgtgcacagggaattatagagctgccttgcatagcactgtggctggtgattttaattgtcaacttggcaacatctggaattaccttgcaagagacttccaatgagggcttgcctagattgatttggtctatgcgcatacatgtgagagattttcttaattggattaattgagttgggaagacctatactaaatatgggcagtacagctgtgtggagctgctgccattaagacttccaagcaatggtgaactctaacctagaaccctttctcccctgggctgattttttaatcacagtaactgttgtgttttgtaaaagagcagtatagtgttccccctgaaaaatcaagccacgagacagacctaccataaagatttattggctagggaagggaaggggtcctggaaagggatagagacagagaaggggggcagagaaggacagaaagaaagatgagaggaagaggcacatggggggggggagcatgtggggacagagagagtgaagacggggaggagaataggagatgaagataaaaagagctggaataggtaagataagccttataggctatcatgtgatggcatgtgatgatgtaagctgttgctatgttgctgttgctaggttcctaggaggagcctaatgaaattgtctttaagccaatagtaaccagaaaagaaacaaagactggcaccatattctgttttcttggagattgtggcgactacttaatgatgcctacatgaatagcgtaagccatacataatataaagccagtatgtgaccatctacacccacttaaaaaaacaaacaaaaaacaaaaaaccaaccaaccaaacaaccaaccaaacaaacaaacaaaaacacttgtggtagtttctaattggaaagcaatacatttactacaaattatggccagaataatttcttgtccatggtaggccttgatttagaaatactgtgaaacgtacaatgcacacagtttgaaatatgtatagtccaatgtgtaggagtgcttactcccctaaaatatgaaaggaatgaggagtaagtttctgatgaacacatttaactatgtcctaaagggactgtttttccacccagcaatagaataagtttagataattacaaaaagggtctttgccaaaatcatcgctaggtccttcatagtgagcaccatggtcttttcagagtgtttagtggggaaactatcattccccttggaggaatggccagttctttcactactgtaataggttcagtgtctagactttcagttaactgtgcttcctcaagcttaaaaatggggaaaagtatacatatctgagaggtagatttacttagctaccttcagttttagtagcagagtttcagaattttgagtttggcctctcctctgaaattaagtaaaaagtgttcagtacaacataaactcttaaaaaaggcttcactgtcatcataaaatggcaagggtccagatataccttcagttgttttgattgaattggttcttatctggggcttaggaatttttttataacctcccaggtgatattaataggtgaccagggctgaaaaactattgcatttttaatctttagatcagttgtcaggacaccgcccactctacactggtggattctattgatgccactgtgatattgcactatggttttgaaagaggttaccactgggaaattttgactaaatgggacatgaactggtaattctaggcttcctgccatagtgcttgttaatatgcagtcatttaaaaataaagcaagattaattcaatgtttttagtggtctgtttgtgaattctattcaaatcacctatgactctttagcatgcaaatttatggctcttctctcagatctaacaaatcagaaagtctgtgaaaggtctcctgcaatccaggttttagcaagttctctaggtgattttgctacaactgaagaaaccaatttaggtgcttatctgattatgtctttgagcaacgattcaagtctttacttaaattgctatcagaaagattgacctgccaatgttcactttcccttcagtattctcctcctgtacccacttcactcgtctcaggagaggtatttttacatatcaagatggtgtgatccttgtaaagtaaatacataaaagtaatacatggtgagtgttcagtcattcattcaacacatcattaatgaaaatttgaaatttagcagatacaatgtagtgctccatttaagatttgggacaagaaatgtgcaagataaccctttcgtgcatatcttgttaagcctcaggactaatttcatgtagatcccctcctttttctcacattggcagacactgaagcagagagagaccaaattcttgctatgtatattactcatatacatcatgggtcttaaccataagagctctgtaactatttgtcaaatttgtaatctgaaatgaggttgttgcattgtgataaaatatacataagatgtttcatttaaaatgcagttcatatcactgtggaaatagtccagtctatctccagaactttttctcaaactaaagttcagtagccactaaccaaaactttaagggtatatttattacacagtatgtgacattttccccctagaaattctctacccatggaagttctgacaaaagatgaagaaaactaattgggagaaaagaaatttgccagaatttcccaaatcatgctatgtacacaagccttgtgttctgatccaactaacatagggctggactttgactgactctgaaagaagtaattattaacaacattgtattgtgataaaaaacaaaaagaaacaaacaccaattccagctgtagagtcagtcagtctgttagaaagtcagggtggcctggcttaatgacttagggtcaataattcagccttttgtgcctcaattacttctcatttatgttataaataagcatattgatgctgccagaataataggctcattgtgagtattaagcaattaatgtatgacaagcacttggaatatcacccaatatctcctccaccaacgtactcactcatccgttcacagtcaaaagttgtttatttcaattgtcaattttatgttgttcatttcatgtacaccgtctcactacattttcacagttcagtagtaagcacagtatctaacaagctaagggtttttttttattataattattttaaagtagcagattcctatcctcacttctagatctcaaacagtttcacgtggaaagtttgttaggctctcgagagaatggaatcatcccctgtctataatatttgagcaggaaaacattgctttcaggaagacacatttccgtttttctttcccttgactcgataatagagagttgatggcaaatctatgggcaatctaaagatataactaattagaagagcaaattgaaattgactaaatctctcagaactttggaaaaatgacgtttcaaatggtcaaaacaattacttgggatgcaatcattgcatttaaatgcaaggcagtgtgcagtggcaatacaaaagagaaacgaggctcctgtgaaattataaatgctaaccctgccccttaaagcaagcaaatgtctcttcctattgttactagctgtctcctaggacaaatagtttcgtattttatgaaaggaaaaaaaattatcaaaaacatttccatgaaatgtacctcttttgaaaaattactccttgaatctaactaaaagaattctttagaagccactgctgagatgattcatctccacaaaagaaaaaaatatactattcaagatgcatatgtggaggtatgttattgaaaatcagagatgatttttaaaataagcttcaaaaacccgaaaagaaggggggaggaaatttggtaattagagttataggttattcaagtttggagattattttcattcactatattattatgcagtgacaaacaaaagataggaatgattttttcctgatgtttccactgcctaggacattgaagcatggagggagcttagccaccactaggaattttctttgatggtaattatgtgacagaacaccaggggtttcactttcagataaagatggacaatgaaggtcaatttttgacctgcctttttggatattcagcactagcacaatttaattgggatcaggtaattgctcagaaggctacactgagcacattatcatccctcagtgtcactcctgcacacctagttatcctgatgttgtttgtcaaaaactgtcacaagggagtacatctcactaagaaaaataacctatgtgtcattgctcgaagcttcaagacaaaactctaaaggaatgagaaaaagtacttttgagcaaaatattttcatctctcagctgattaaacttatatattggtaatattacagtttttacaaaatcaactatttaaggtggatcagtgatccttgtttctctagttcatggaaaatggtgcctaatgtctctcattgtttcttggcattgaaggatgtttgttttaaatatgttctgtatagtattaaggaattttgcaagttgtgatactttcttaaggatcatagtactttcaattttgtttcatagcaaaagaaccatttttgtaatttttcatcattgaattagaaacaaaattatgacgtaatgtagaattttcataataaaaattgactataagatcttaatgaaagatcttagtcacactagtagggggttggtctgtttcttgtttgttttatttttcaagatagggtttctctgtgtagcattggctttcctagaaactcactccttaaaccaagctgtacttgaactcaggaatctacctgcctctgtgcctctgtgcctctctgcccctctgcccctctgcccctctgcccctctgcccctctgcccctctgcccctctgcccctctgcccctctgcccctctgcccctctgcccctctgcccctctgcccctctgcccctctcccctctgcctctctgcctctctgcctctgctgggattaaagacaccctgcataacaatactattatatataacaaattcctgtaatttataataactataatgagaagtagtgtttgattttatttttttacattttaattgcaatccatgaattttgagtatgttctactgaaagaggactcaaatgttaattggcaataagatttccaatgaatttattcactgtagacaatgaactgaagcaaatattactctgtgctacattctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtttttacagtttgtagaataaagatcctaaaagtttctatgaataaagtggaagccaaatgataaattgaactaaactctcagtaaaacgtatttgtatgattcttttcctaattgaagcttcagagtttttcactggaactcatcacacatttagagaagcttgcacctgagtgcaatatttcaaaggcatgcagcaccaagagtcatgctcttctcacatactgctgccattctcacatgtgaagataagaagcaggtatcatatgcaagaaagaacttgatcatacagaagactgctttgtctgtccttctgaataatgggcacccacgtgactttaacaaagccatcagccttgctttcactaggaggtagactttatatgttgcaataaggttcaagatgtaaactttaaatgaccaagtgggctgtcatctttcaattaatttgtattatttgtaccaagagttcttttttaattatcagaccatagaaagagttgtaagtgcatttatgattagagatacaacagaacataaaatacaatgaaagcacccacgacacatttctaaatttttccattgatacttctgcctgactttaaaaagaggatctttgttttatccaagccacattttacatttcacatttagcttcattgctgaaatagaaaaaaaaaaaaaaaaaagaaaagaaaagaaaactgtgtattggcaggcaagccctagtcagagcaggactcaatggtcagagcagacatttgttcagtgcttagaggcctgtcaagatgaggaagtctgtttgatgttctttcttctatgcctttgctctccctggctcagtcagttcttgcctctaaacagaactcacccatgtgctggagaatgagatactaaactaggccaagagctgctgctgaaaagctcacgccactatctgctggaaactaattaaaattactgtttcaataaaacagtcctctactcattccagtgacagtacaaggaaaagaatccatcctttttgtttcctttgtttcacgtagtgatttgtgtggttaattcattacagtctttgttctcaagtggaataaaataagccagtgaaagaagcatttttcttctttgctttaaagtgcctttcctttttaacaggtacaactcagctctcagttgtctttaggtgtgaaggtaatagcagaggttgtaagcatttttttaatcaatgatttcttaaatgtcattctggttgcttacatgtgaatatagaggccatattctctctctgtcaggcagccagggcattgccactagtataatttataacatgactaattaaaatgaatttagttgcaataatgtcctgtgtgctatttgtagaagagaagttattaaaatattcagtacagctaccgtaaacttgaatacaaagtaataataatcatgcatttttaattacatgcttaatacccatttggctaatatagaagtattatgaaaattgcttaggctcagcatattactccttgtacttagtggtatccaaagacatccttcaaatgggctcacannnnnnnnnnnnnnnnnnnntctctctccctttcctcctttcctttccttttctttcatcagacacacagcttggcatttccactgcttattgccatttatttgtctcctaacaaggatgtctcttattaaaaaagaatgcaagttttcaaagatgtctacatttctgtcaaaattcttagaagtatttcaagcaacaagaaaataatgagtacacatctgctcttcattcagagctaagacctgcatgctctctaactctttacacacaccccctccttctacatataggtatgtatattcttagatgattggatgatttttctgaacgattttacagatgtcttctagagacttatatttccccagctgtctcacgaattaatgtccattacagattttccctagtcactactttggttctaatccagaagcatgcagtacattcagatggcaggggtattccataatcttataaaagttttcaatctcttttatactcttaaagcattggttccaattttaaatagcgttttatgttttcctttgttgtttttttttttaaccagttcctaagatgctataaattcacacacaataaccataaataaacagtggtcactaataaggattttatctttatacaatccacacttaactctttgatatcccccccctcttttattgggaaggtatttaaacatttatgtggcaagatactttcttagtcttaaaaaatactgtgtagactactcgtacctttcaaggcatcaactctacacaaagacctatgtgaaacttaggaaagcaaaaaacacggatatttgctctctcctaggaaagaacacaccagttggttgttcggtgccaaatggcaaaccctgaaaacatacatacatataatgttatatggaccgaactgaggagattgaatacgtatgcacacaataacaataagtgaaaaggggtgcattcatttttaattgaaaattaatatgctatgttttgatcacagtttacctcccccctcctgcatccattcaattccaatcctatcgttttaaaaaacaaacaagaaaaaaaccctcagttaaaaaatataacacacacacacaaagagagagagagagagagagaaatagagagagagagagagagagagagatcacaaaaacaaaaactataagatcataaatatgtcctaataggagataaatctacaaagaccccattgggtttgtttgttcttggccgtctaccacaggcacaggaccttaaatggagattttacacccagtgagactccattggagaaagcaagttttcctttgccaacaggtattagttgtggatatatttttgtgtgtctacttccccctatcagtgctgagacctcatctgaactgaatttatgaaagacctgtgcctgatgccaaagtctctgtgagttgttatgtgaatcattccaataatgtccagaagacaccatttatccttgtattaacccctctggctcttataatttttctgtctcctcttcctcataactccctgagcccagatggagacaggtttgatggtcccttacactctgagcactgtccagttaagggattctatattagtcaatatctattgcaaaaggaagtttctctgatgatggttgagctcaagacagtgatgtatgagtatagcataatgtgatttggagtcattttattgctgtgttcctttatcacaaccagtagcatttagttaatagcaaagtattccctaggcccatggacaatctagtctcaggttctttgccatctaagccatcaggcaggggctctttctcatggaataggagtctgtgaatttgaaggagagcagggaagggcatacgaagtatttggtggaaggaaaagaaaaggaaaaatgttgtaattgtaatcttaaaaattaagaaaacaaaacaaaaatatcagtgtatgcacaatatgtatgtatagatgtatgaacaaagacatgtatggtaattttcatgtacacacatgtgtgagtgcaggctcatgtgtggatatggctgcatatgggtatcagtggagattttggatgttggttcctatttgatgcttatttgtatctctcgttgctgtgtacctgaaagattccaaggactttcatgtctacatcccatcaactggtgtgaacactggaattgtggatgctacagtcatcaggcttttatgtagggtctgggtgttcaaattaggcctcatgtttgcaagtcaagggctttattcactaaaccatctccctgatcaacttattcatgctctcaatgaagattttcctgtatttagaaatggatggaaggttatttggattctagagaaatgtataattttaacaataagaggagataggaacatgaagagaatcagtacaactgaaggatgcttagagattcacactctgttgctagacagtttaccattatgactaagtactataagaaattgtatcaattgtgatttatatattaattgattttagaaagatagtgcaatagtacatctgcataagagtatatggcttcaaggacattaagctaattatggctcataaatatgcatccttttacttatgaaagctatgctataaacttttggtatctgatgctttaaaacatcattcaacattgaaaaattcctaagagagactaagtaaatgatgctttcaaatacatacctgtttgtggtgctatattgtgaattagatcactatgtgtgtgacagatctctatacaaagtttattcttattaggtattctgaattttatatctgtattatgtttactaagcctgtctagcttttattcatcattataaaacattctatttttctacttaatgatctagacaaagagcacaagatgtttaataataattctttacaaattatgtttgtttctttagactctaaagtttagagtattgtgacaagttttgtgatagattttctttcaggattcaataacctaagaatgaaaagccactttagattcagtaactccaactgcatgaatcttctcattaatgagttttctcaaatgtgttttaggcagaatgaaaattgctgaatataaactaaaactgctcagagaaatgcttttgattatgcactttgaaaatgaaagtgaatgtgcagtgtgctcagttccctcttcagtgctcactgtgtagctcagggctgcacatgtgcccagttccctctcctctcccccagtgatgcaattagcgttcattgactgatggatcacacacttgatgtcgatcagtggtcactaagccaaccacaccttacaaaaggctttccaagccattaaagtgcctggctccatactgaaggataaaaatagacatgatttttcaatcatatttacatagagtttgctattcaaactatgatctgcctgcttatacctatttacatttgctttgtgattttgtttctccaggagtgaatataaaatttatagacttttttcttatgtatttcactctgttttagttttctttaaaagaatatgttcataaactttgtttgtgctatttaacagtgcttataagtagtgtttaatatgtgttctggcatttccaagagggctttttaagttacagtcaatctgaaataaagtatgtgcaagatctcatacgtatttcttttgcatataaattgtaattcaagatgttctctgtgtgttgagcagctcacccggtccactgctatccaagcatcatcatcttttgcacactatacatgaagtccaatatgcccccctctcaatctttctgctaacgcagtgaaataaactttatctatctcagcagtcactgggggatatttcattgcctcagtccctagtaaccacgaatctgctttatgtctctggaactttgactattctggacattatatataaatgtagtcacacaaagtacagtcttattttgtacagcatttataaatctggcctctttcagatagcataacatcttcaagatacatctatgtttttttgtttttgtttgtttttcttttttgctgcatattccacagtttacatatccattcaccagttgatgtaaatttcgttgtatttctgtatttgatttttggggggttgcaaatagtgctgctatgaatatctgtgtacatattttgtatggatatattctttcaattttcttgattatatgataatatacttacaaatgaaattactaggccatatttttaagagagttccaaactatttctcctcctcttcttcctcctcctcctcctcctcctcctcttcttcctccttcttttccttctacttttaaccaagtggttattttactttcccactgaatatactctagtgtcaactgtttgtattcaaagtacaacgttaggaagacatttttcacttcaagttcattggaaattattggctatatttgaaatgaaacattccaaatgacataagaaaatgacactttccttgatggctatggttagtattagttactaaactgctagaatgaaggattacctgggaggtgagcctttagcctaagtgactgtttcgagtacattaattgatgtggaaatacctatcttaattgtggatgaggcctggactgtactggtgtagaaggtgttctgagtcttacctccatccatcattgttttctgttcctcattgtgagtgcagtgagaccagctttttcaaggtcctgccactgtgatttctgttctaaaatggactgtaatctgtgagactaaatgaacccattctcttttaagttgcttttgtgatggtattttgcccagccatgaaaaagaaactaagacaataacaacattattatggtggttgactataatcattgacaaagcataatgtctgagattctggcactaaaactgatagatgcatgattatacctttcaaagcccaacataaagccaaacaatagctgagtgtgatagtgtccacctgtaaccctgcccctagggaatgaagcagtcacccagaaggaggaagctgtggttgatgactctgcatgcttaggctttagctaaagttcagttgatcataatacccatacttgaaccagagaaattctttgtcattatcctgaacttgatgtaggtaaaccattgtcatatctgtgtcaacaatacacattcattcagaacttcattggctcctgacatgaagtgaagtacattttgtagcatataaagtggtattgtggaaaatatttattgaatagacactatattttaggcaaactcacttgatcctcacaggattaatataagtctgttattaaggtattattggtctacattgctataccttaattgttattctatgattccaacatgttatcttctgtaagtgttcttcaggaagttactgaatgagcttgtcatgaaagaaaatggctgatgacatttcatgctgtgggactgtcaccatcaagttagaaatattcgaggaatggcatataaattttcataggtaaaaatttgtgtccaaaaatatacccatcttcaatgcaggggtgaacacaactgtgttgtagatcatacattattgctaattttgcttccttctaacactgaaccatggttttgaaggaaaatttttgtgtgtttatagatttaaagccaaactatctacatgtgccatcatttaacactttttagtacctaaggtatttggtagggtttttctattgattgaattcctagaaggaatattcaaggctatagaaggaaaatacaggaaaagtaaaactaatgtgtgtttttttttccattattttgcttcaaaagattgtggtgattgttttgaaactagtaagacactgcaatgacttgaatatctaacacggaaccaaccactttacctgctccattcacctatgtggttttatcatctagcttcagctttatcttcaagggaagaatatagtacatgattcctgatcaaaaaaaaagaggcatgttgaaatactgtttactctgaccttgaaaaagaatctcaaatctggctttcaaactgtcaatttaattcattgtcaattttattatctattatgatgagatagttatgatgtgattgagtctgactagatagtgtctattcatccataaaaggggtatattaattttggatattaattattatattgccatcatagaccatttatgagtttccccttgtcagcacatctataagtatagttgtgttgtgttagtgctgtataaggtttgtaaagaatctcaagtcactctacatacccttctttctttctcatttaagctttggtatgttgtgaaaccaatgtcaaagaaaaccttaacttcattaatatactatggttaaataatattatgctgcttatttactttaaggttacagctttaatgcatttaaaagaagctgattttgttattgtttgatttaggtggcaaaaacatgacaggagctacttaagggatcatttatttttggtcatagagggtacagtttttcatgtgggaagaggcacaacagtaggaccattaggcagctgttcaattgagaaatgaatgtggcggtcagcttgctttttactttttatttagcccaggagcacacatcttccatggaaaggtgctggcaagattcaaagtgggtctttactcctcaattaagacttgcagaacagtggttctcttcttttctacttctgtgacactttaatataattcctcatattgtggtgaacctcaaccataaccttgttttattgctactcaataactgtaattttgctactgttatgtaacagtgttttccaatggtctaaggccacccctgtgaaagggtcagtcagttgagaacactgttgtagaaatactctcacagacttatatacaggtatatctcctaccttatatcaagttcagtgaagttgataatgaaaattaacaatcacaaccatgaatagaaattacatatattgcatattctctctctctctctctctctctctctctctctctctctctctcactcagatcagaggataaagagaaaggggttgaccagtgaaatgattcctacttagttccttttcctcttgctttctactttaagaatttgcaaattccatatctatttccagttgtacccgtcattaagacagttctctattcttctccatttactagggagtcctgtggtaactaacatcatttcctcatggattcctctaaagtcatatggcagtaatgatataatctaagaatgactttacccttgctaacgatatttcttgatctgataaactgcatgaaagtcagttgacaatacaaaggaaaatcatttcagctcaatatgtgagaatttgaaatactagatgtaggggaaattacaagtgaatacataattaactcttaacctacaaattcactgaagtagtgcagtagttcaaggctgtataataaggtaaagaaggagtttctatgccagtgctttgttgctaagtaattgtttcttttctgagttggtttcatctatgaaattatgcatgtagctaatgataaagagactttgactttttgcactaactttttcctcttggtttgaagcagtgcccattgactttcattatttattcaaaacttccattattactgcttgcacatacataattttgttactaagaaatttttttgagttcatatagtgaagatcattgtggtggctttaatataattacatttacatctaaagattaaagcatataacttatgaaccagacttcacaagagtttaatttgaaatgaatattttaattcaactcaattcctgtgttattgttatatgtccctgtattgaattcatcattgtattaacttggacatcagtgctatttcagatacaggatataacacaataacaatgcagacttaacttctgtctgagctactgttcagaaaaaaatatacatatatacatgtatgtatatgtatgctattggtgacatcaacattttattctatctagtataataagttcatttgtgtgtggatgtgtatttgtgtctgagagataaagacaggaaggaggagaacattcatgtgcaaatgtgtataagcacatacctatgtgccttgctatgataaaacctaaacaataaatataactaagatttatctgtataatctaacctcaaataataaagtgaatgaaatttgagaggaaacacacatggtttcccaatattatgccctgtgcaatcatataagaatatatatatatatatatatatatatatatatatatatatatatatatatattacacttttacctgtatagttatgtaaaatttccagtgttagaatcttctatttataggaatgcttcaggccttctgcagcatcttccttctttttccacgttatattttctctaattgacagaaaatggacggagtaaattaagaattgttttatgggagcaaaccacatactttttgttgttgttgttgttattttggtttttttttcctaatcggtggaattttctgttcatcatagagctcaatcagaagggacatatacaatgtttataaaaaattaaggagcatttgtgagctctctatataattaagagctaatagtaatgaacaagagatattctcaatggttaagaatacttgttgctcctacaaaatttgagctgcacatatattttaaattaggtttattatttaggtcttaccatagcaagacacatagttatgtgtagaaatgcatttatgcatatgtgcatatgaatatatgaatttcctctctgtctttctaatttctctgtctctgtctctctgtctctctttgtctctctttgtctctctctctctctctctctctcacacacacacacacacacacacaaacacacacttccaaatcccaaagcatttattatctgtaaaaaactgtaaaacattgccagtacccacatggtcattcacaactatccataaccctaattcagggaatctaatattttcattgacctccatacataccagacattgtacatggtgtacatacatacatgtaaaaacactcatacacattaagtatgtataatttttactgttttaaaaagattaatattgaaatatttggatgtgttcctttcataagcaatactaaagaataataatatcaatctgggcatggtggaacatgcccttaattctaacactcagtattcaggaggcagaggcaggaagatctttaagtttgaggctaacttgctctataaagcaagttcaagacagctatacagagaaaccctgtcttgaaaaaagtatttattattaccactattattattaattattggtatttgaaaatgtgaatgagtatcatgctaaagtatctataaatgttatttatctttcatactacttaaaattctaatctaaatatgtttttagaagtagatacaattattgatattcaaaattcttgaaatttaaaaacaattacttgtcattttagcatcagtaattttgaagtgtgtcatcttcaaaacagtgtggctcagccacctagttgaagtaattattttggcaggggatggagatgttgggggggggtatatcctcaccctaaggagctcagccttgatgtattttaaaattggatcttcattgttttcttttgcataaaatagtttatttgttttaaaatgtttgaaaatcaatgttaattagcagttaaatttctgttgtctttgttgtacaacacgtgaagcacaatgtctctgcaatgtgccataagtataactgaaacctaaacagaatcaccaaatagtatcagtattttacacctgtcatgtgctgtttcaggaaagcagatgtaattggaaaaccacggtagacatcttaagaatttgttcataattctgaacagagaatgagggcattttccagagccatgagctttggagtgttattctaagctactgtccttccattttgtcactgttattctcactatcactgtatttattaatcatcattgtggttgtttgaaaccttacaagtgactttagaagctgaggcagaataaaaactatagttatagaacagaaaaaaaatatgaaaagaagaaagggagtaagagaatagtatgctttggtgtgctgatatacctgatgtagaaatagtcacctagtaaaaataaaactggaaaacgtaaagctagtatgccatttcatattgctttctagaaaaccttcatcagataattattctatgattattgcctgagcagaatacattgtgtggacataaggggaatgaaattcactagggctgcattggcttcttatatattttagtttataatcatagatcaaaggagcacacatttttccttatatgtggatatttgcttttaagttttgcatatgtgtttcaaactgaataatcacagaggagaggtataaaggaaatttaatccagcaacatggttgctttagcaagggatcacatacaaggtcctaggtctatgtgatccatctggaatggagataggccacacaaatttaatctgttaggcttaaattcagacatgcccttagtatgtaactttatttttttttccattttttattaggtatttagctcatttacatttccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatctgcaaaagtgatattttgacttcctcttttccaaattgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtataggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttgggtctttctgtggtttagttatcagagtaagagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaagttttatttgtagtaggaaacagtcatgtttgaaattgatctcattcgaggggtagactaagtgaggaatcagagaaccttttaacagaatgagtcagagataggatacacccaactcttaagaaacagaataggaaagagaggtgaatggtggtgggggggggcagtgtggcagtgtggcagttttatctgggacagtttcacagagacatgttagatagacacaggagaagaaaggagccagagaatgagaaggagccagaagattagaacatattgccaaacttagtatgaggccaagcccaccaattcagtgagaagccaagagaatccagattgaatcagtcagcttgaagagcagtttcaaccagctgaatttaaccagccatctagagttcaacaagaactacatggggtaaatttattcagcagtaagcctctgagttaacaattacatctaaaaaaataaaagagacttttacagagaggtagatagtaagagaccaggaaagaagaggataagttacgaggaaaggaaaaaaagagtacatatttttaagagatagagggaagctagaataaaagcattaagaaggggtagatataggagtcattgtaaatgagtaaatatgaggagaaaaaactaatactaaaggttacttgagaaaccatatggaaacctatgtacatataaaatctaaatggactaaacacatagtagaggagataatatttcagctagacatcttattccatgaaggaaaacctccagtgccaggaatgagttacatcttgttgagctattggccaaaggggttccatagattcctccaaacatcatatgctgttgccaaggctatttgttcctctccacaataaggccctgttgttgaaaatgatattaacttatgccattgaacatggggaagttgaggtaatacccaactagaagttataccactatggataagcattatggtacttgaaggtacccttcaagctatcagagaagtaatcatcagtttcccccagatacaccctgtgacctacaagagaaacctgcctataaataagatgtactagtgttatagtggcccaaatgtaatgggaacaactttatcattgtatttaaggcccactccatgagatagaacccataggtctcataaggctaggggaaagcctactatttttctgctaaaggaactgtaaaggtcataagccataaaaatgatgtctactggcttattgctgtacccacagagcagagtgagagagacaatggaatactcactcaaatgtctccatcaaacttctcccctcaagacactgggatctatgtagaagaagaaaaggaaagataagatctagagatggtggatgactccaaggaaacagtatctttgagacaaaacgggactagcacatagtatggactcaaagactatggcagtatatacaaaggaccagcacaggttcaaactagacagaaatcccaacaatgagaaggggaagtgaacataaagtgtcacccctaaccaaaagctccttgcaactgatacctgtagggaaatgggaaattagttttctttaacactgggggtatcaaccacaccctagggcagatcccaggcctagtagtagttggccaacacaaaagagacttcatggattgctattgttggtgatggtgatggtgtgtgtatgtgtatgtatttgttttaatatttttttgttttagtttgcctattctttggatttcttttgttttgttttttccttttggttctccagttggagggagagatccattatttaaaatttaaaaaggaactaaatgtttatttttaagaggcagcatatagaattagaatccatgaaaagggaacccattgttactggagcttgagtgtgagaaactgacctctggtaaccctaataattttgtcttggccagctgtcaccaacagaccagtttttaaaaaaagttatagtgaagagcagagaatgtacatttattcactgtgtccacattgggaataggaacaaggaagcttagtgacctctgagtataactttagggtcttgacttgatgtttagaattacctatagggtaagaaacatgtgtaactaaacagttgaggtcaaagtataggcatacacatcactgaaaaatcaggtctttcttgcaagcttgtttgataagagttcagaactttgaaatctctcctgggatacagattccttttctggatcgacaggacttctagcctttttgtttttaaacaatgaggttgccctggaaattccaattccatcttttcaatagtccaataatcaaaaagaaaggcatttatatcttcccttttgccaagacagttgcactattatactgccagcactggggaaatttgttctgtgtcaataatgcttaaactaacatcttaatgataagtgagaggtatattgtcagagatagaagcaaggttcaggtttcaatagagaaattagcacatattatgctgagcaatggatgcttaatttctagacataaattagaactgacttttcctcttgttttccttgatgctaaatatctggaccttcagagtgagtgtgataattgcctatttcaatgaaatttgctcagagtgtctgtaagagactcaagaaattgggcctgttatttcatagtgtggggaggacactgactcctgggacacatagatccatagtctatgtagaaagtggaaggttaactgcaggttgagactttggcaatgtctgctattaatttgctcagggagctcttcaagtagagcagctttttgtaagtcactcatatttcgaatgatagtttttttaataattatttaatgtatatgagtacactgtcactattttcagacactgcagaagagggcatcagatcccaataaagatggttgtgagctaccatgaggtaggatttgatcatcccctcctcagtacaggcctaatcaatgatatagattacagaacaaaacatcaccattgtacatacactctcaacataatctctactcacccctgctacatttttcaaattcttgccacatgaatctctttgcttattcatgaacatagcaggcaattaggctctgagacctttaaagatgtttgcacaacctcttctcctaattgctaagcacagtttgttccattgggccttatgctctcatactctaaacttaccttgcttgcatttttgtaattatgttactttagcctgcctctccccttttctgcattcactctaccatgccatgtattgtaaagttctaggatttgtttgatttatatagtttctttatgtcttgtttctatgcttttcttcagatggaaataaaaatttgtatttttgaattttagaaactttctagaatgaaagcaagagacagtgggaaaggagagatatagggattgtgataagaagtatttagtattttggtttgttagctcctcttaatcagatgtgtgtgctctcagaagactgaccattaataattatcttataggcattattaaatacatccaagctttgcctatatgaacaaaaacatgtacatttaaaaagttagcatgtttcactaatgttgtttaagttcttatttaggaaccactactaaatacgcatgttcaaaaacttatattaacaaaactgaagaattatgattttagactcagtattattacttacatcaaattaattcattgtgcaattattggttcattactcactgctaattaggtacaattaaacatgaaactcctcagagttgaacatgttttttagtcaatttgtaattgagtcttatgagtcaaacaacacttttaaactgtcaggcatttattttttactgtttttacaaaccttgacactagttactcagggaactctgaggtgggattgctatcagattttcaccctttgtattccaaactttttttttcttctcgatttattcattgtacaaactgaaacatgcagactgtaatagaaatgagaatcctgctgggctttttagccaataataaaaaatattttcataaaaatggaagtgtacaagatggtaggcatctgttatttaaaaacaacagtactatatttaaatctaattacagtgtaagggctaagctttgaagcaagaacaaatttatttacggtcatctaaataggggaaagcttttatgttctgctttctttatgctgatatgagattggataacagttgatcatctttaattatagacatgattgcttgaaaatgtaatattttcagttatttatgaaccacacggacacagtaattggacaatcctgagaaattttcctttacgtctgcatagcttgaaatgcagacacattatctcaacaaatccacaaagatatgtgacagaagaaatcagcagcacactccgaatgatctctccctccaaaaggttaaaacatgtaaatcctactagaaataaaaataagagtattttcacaggggttttgacaaattaaattcaaatgtgatagggttttgctataaaagtgtttttctacatatgcaacaaaataattattaaattatatagttaatattatctttatagttaatatttcctatgcaaaccactccaattattgcttcattttccgtgtttatgaaaagaatattagaaagtgtacatgtgcttttcatatataccattatgccttatggattaaaaaatattaatataatatatattccctgaaaaacaataattcactattataacacatacattttacagaggttaataagttacatatcatatagagattttgactgaaagtatacaaaggaattaacttcctatatttattatgttaacatatcaatagacatttatttttccttttataaactacaagagtgaacattgcaaattcaatagggaatgtagaagagaccatggtctcaaaatacccaaaagacgagagtgcccaaagagaaagagttttttgttttgttttttgagatagtgcattagattggaacttgctatatagaccatgctgaccttgaattggcagcagctacttttgcatttacctcctgtaatttgggagtacaggattagcagcgctggagatctaacccagagctttgtgcaagcactttatcaatggatctacatttcccagaccaaaaaaaaaaaaaaaaaaaaaagcctttaaagtataactttattctctctgtcataattgaaattgccaaccatttcttcttggatttgtagggtaacccttgtcctagaatgataacttcatagggaatgtgttggtcataacagtcctccaaatattttggtgaacatgtgaatgaataacctttactcttatctttgaaccagtacttatttctcctaccaagatatcaattattatactttatgtcagaaaaatctttcaagattgtctacagttcttctctattatgcttctatttagtctttattataatactactagtagaaatagcaaagaaagcaaaaatccatgcactaaatgtgttccatcatcaaatacttataaatcaaaacatgatatatatatatatatatatatatatatatatagagagagagagagagagagagagagagagtgaaagagagagagagagagtaatgaaatgtatactagagtacactgtttaaaataacaaattctacatgaggaatcatgtcggggaaagtatccattactaaatcagtgcttctttgactttaatattctccaatatctcctggcaatcacattaagatgcaaatctgtactttgtgtgtgaaacctgggaatttaaatttacaataaggcttcaggtgatactgacattgcttgttcatggacaaaatattatgaagtgacatatgaagtgaaatgaaatatgaaatgaaacctgaaatatttatttaaaaataaccatgtttgggacaacaatgtagctcagttactgccaagcctattgacttgacaacctgagtttgagcattgtacccacaagatagaaagatggatcagtcttctccaagttgtcctctaatttacaacacatgtacaaatgtgcaggtacacacacacacacacacactgtctcatgtttgtgcacacagacatacatataaataaaggtaataaaaatttgtggactatatatgatgaaactgatggacatttatcagtctgctaataagcttaggtttctgaaaatgcccaacgaggatgtatacttatagtaaaaacactatggcggtaaactggaaggggaatgagatatgatctcttacctcaactgacacactggaaaactagagctcacagataatagaaaattgggctttttaaaactccacccactaaaatactgacagaagcaatgtttccatattcccagatccatgtcttttaaaacagaacattatgactctttgatattaaaattttgatagcttgcccttgataaaacatttaaaaaatttaaacatcaaaatataattaggaaaaatgaaaacaaatagtatatttgtgaaaaatatttatttatttatttactatttttgaattagatattttctttatttacatttcaaatgttatcccctttcctagttccctctctgaaaatcctctattcccctctcccctcaccctgctccccaacccacccattcctgcttcctggccctagtagtcccctgtactggggcatagaactttcccaagaccaagggcttcttctcccattgatgaccaactaggccattctctgctacatatgcagctagagacacaggtcccaccatgtgttttctctgattggtagtttggtcccagggatctctggggatagtgattagttcatattgttgttcctcctatagggttgcagaccccttcagctccttgtgtattttctctagctccttcactaaaggccttgtgttccatccaatagatgactatgagcatccactttgtatttgccagacactgatagatcctcacaagaaacagctctatctggctcctgtctgcaaaatcttgctgacatatgcaagagtgtctgggtttgtggccaggtgggccagtctctggatggtcattccttcagtaacattatgttccttaaccaatgaaaattatgctgggcaattctgtagatttgataatgaaaaagtccaatgaatgactgactctggttattcctttacagacactttgattttattccaaaattaaaaattagaaaaagaacacaacaaaaaatgcaaaaacccaatagtatcatttcattgattaagataatttctttatagttgagtttgcttcctaatttttaaaaatctacatgaagcacttctactcctgtataaaaagccttcaactgtttcattatataacaattcaaatttcatcaaaattatcttctattttattgtgtacatgtgtgtttatgaatatgaatgtcacagattcatttttcatatttactatctaagttatacatatagatgtgagtgtctttgtacatatgtgcacatgattgctgatgccaaccaagaccaaagtctttggatgaccttggatctggagttctgggtcgttgtgagctgccctgtgtaggttctaggagttgaactcaagtctgctaaaagagtagttcatttatgttaaactgagccatctctcattcccacatgtttccaaatgtaggcaaaacaaaataatttttcacatgtacattataaaataaaagataattatattatagacattacttagacactatcttattcatagctttatcaaactttaaacactcaattgatctaaaaagttaatcagattctgtcaccaaatgaaaagtcacatatatccatagggactccaaggagcctactgagtttcagaaggaagttacaatattttctgaggagccatttatcatcagttatcatctgtcttaccatcgagaccttaaattgtattaatttcatgagattaataaatggaatctcttcacaagttgtaaaagtaagttgttatgatgtgggtgcacatagtataaacaagaaatataatttataaattaggcttagaaaattaaagattctgcactattattactgataatatctcttgaatattgtctcatagattacaaagtgtttcctcatatgcttttcatatcttaaactatgatgtcagtattttaaataacaatatattttaaagtattattttaatatcacatgaagctttgactttctttgatgctatgtgtttccatagtgattatgattgatgaattactatagattcacaaaaaatattttctttttcaatctgacaacagatgttggcattttaacaaaaagcaaatttaataatccatattgtgctcaggatattaaactgaatattttcaaagaagtcataatagctgatgaattttctaatacctatacattttattaaatactttaaaatataatatatttacattattttcttttttctcttttatccctcaaacctttcccatgtatcttgctctctttaaaatttgtggtgttttcataacttgttttcaaatatgtgtacatttgtatgtttctaaatatatataaatacaacatactcagttcatataatgttacttgtatgtatgtattttcagggctgacgattttgtatagggtaatcaatcgatgagctcctctctgtagaaaactatttctcctgctctccttagttgcctgtagttcttttttgtagggctaaggcctctttagcttcttccccttccacattagcatacctatttttgccatccttgctgaggtcatgttttggcagccatgttgatgagacatcattgtgtagcttctctgatatttctaggcgacacagtctcatagcaaaccctgttcctctgactcttgcattcattctgccccctttcacacaatgaatgctgagcttaggtacaggacttgtgttgtaaatggatcagttttaacttggctctgcggttctgaattttgatcagttaggttttctgctccatcttttgtaaagaggatgttgtgcaatcttccaagagagggaggtgattaaatatactacccagcatttacatgtatggaacacagattagtgtagtttgcatccctaaaatctttgaagaaagccaagcagatgtcatccctaggtgtttatttacctggaaatcatattcctaactactaaagtttgagctaaccactctttttaaagaacagaatcatttttaaaagaaatacatataatgacacataaaatcagaaaccataattaggttttagtttaatgtggttgctttttttctaatatgtcaacaaaatcaaactacagaaagagaatatcttgttattaaggaatgaggatggaattgtaaaaaaggctttaaatcattatgaatgagcacctatatagggaaaggcagtcactgatttatagaaggggcaatctttccttacacctgactggatgaacattgtccctgaaaacaactggttattttgtttgttgttattgcttcttgaatttagcaaggcaggatggacagcaagcccaagcaacctcctgtctctactaccatagtactagagttatagacatgtgcctttatgcctcaatttccacatgggtgctggggatcagaagtcagtccatatgcttgcttactaaacactctactcatggcccatttctaaagcccccccccaaagagagatcttacacttgaaatgtttgtaactcctgagtgtggaatggagaacttctaaaactactttcacgacctcttccaactgcactttaaaattcaatagctgtataataacctaatcaatatagtatcctagtaaagctcatttcttttctcaaagtgactcaaaaaccttgaaaattcactaattttgagatgttttagcatccattaaaatcagttcaagactgacagttactaatgtttattaactgtaagtaattttgtttgcaatatatggtgtttcttatagtctgctaattgaatgcttatatttaaaattgacagaatatttataagcatccactttctttaaacttgaagatgtagaaaactggagctcactttctgctacaaatgaatgtttactgccctctcaccattatctgcgatccaggcaagcgtgcttctttcttggccacagttgttctggcacctactgacattaaatgttgaaatgatactcctgaaatttgaataacgcactgattctctggttgattgaaaacccacactgagctgaataaaccatattgtcctttcattgctctgttatttatctttgtgaaaatactcacatgagttatttctgactcatggtttcaacattatggtactgtgcacaaaatcaatattaatagtagagttttctcatttatgtgagttggtgacatgcaatgtgatcatctttcctggtgccaaattatagcaggaagcattggaagtcctgcagccatgcttgcgatcctaaaaggaaacaaaactctacacagtatactgcttccatactatggtagtcagtaggataggtgtatttcatggagtttgaactcatagtattttcaatttatcattctttcattaaggtgcttaactccattataagttgaggagcatattgtgggagacaggtggagttataaagaaagaggagagagagacacacagagagagacagacacagcaacacaaagccatagagacagaggcagagagggaaggagatgagggaagagatgagagtaagggagagaagaagatgtggagggactgaagagaggagaggagaggtgaggagaccatggtatatgttaagttttcaatagacaaagtaaagttgcatgctatacaggtatgagagtaagacacaaagaaaaatatgcagaaccagttccagaacacccaggaccacatagggaaagactgtttcaagaaaaacaaaacaaaacaaaacaaaacaaaaacaaaacaaacaaaagcaaacctaaaaagctgaacattatgatacctaaattaagccgggcgtggtggcacacacctttaatcccagtacttgggaagcagaggcagaggaatttctgagttccaggacagccaggactacatagagaaagcctgtctcaacgccccctcaaacaaaacaaaacgaaacgaaacgaaacgaaacgaaacgaaacgaaacgaaacaaaacaaaacaaaacacctaagtcccagaagaagaagtggaccttgagctaactgataattcttagggggaaaaggggagtaaaattttacttaacatagtacatttagaagaaaaaattttatgggaaaggaataaatataatccaagtaatttgtgtgttattttcaaaaaataaatgaaaacattatttaaaaataatttctatggagaaataacatacagaactgcctaaatatgtataagaattttttttatatctatgacactttccaatgaagcttattgtcagaaaaaaaggatagtgaagggagacatggaaggcatgtaaatgggtcttatatatgatgtttaaggatattctttctcaaagaactaaggtgtttcgttttctatagtagaaagaagtcaatgtttttaggcaagggtgtgaagagccctgcctacagcacctggctttgattatcagaaagaatatgagaagctggcaagtctgtggaaggctttaaggactggtaatgtgcagacggagaaattacaatggacaattggagaaatcagaaaagtatatatatgcatattgccccatgtgtgtataggttatcagaaggagctaggctgcaaaaattgtgaagaaatcatgtctgggtcaggaagtattttctgcagcatggaaagagttccctgagaaatgtggaaattctctaacaaaacattcttccacataaataataattggttatctttaccagacattctttggaattcattattattattgctatcactgtgggttttagcattagaagtcacattttagaaatgtgtatgacctcatgttgtcacacatcttggggatattgctgaaagtaaaacagacactaaaactgatttgatataagatgacacacagtttaaatgtgtatttcttctttgttattttaaattcatgctcttgccatactggtgaacacattgtctgtgtagaatggctgtgtacagagcacaaatgaaggctaccattactctaaataatagaaacctatttctttgaagggcatttgggcccctcccaagttatgaatatcatgttggactttattgaagtaaaatcccccaaaatgcatcttccaagtagatataagttcaatatagccactggtacttaacatagacttttaaatgttcacattgattatatttatttattgcactgttactatgcacctttttcattcgtgatttacatttctaagtccccttttccatgattaagttctgcatgtatttgtcctattaaacatgtcatcactgacatagcatactttggccattcaatttttccatacctgactctacttcctctagtgtaggatcctagtgcaatataccaagcataacaagctgcctttctaagatacaagtcacagacaggcaaatagcatgcatttcaaatgaagtcatattctgtatgttctacaccatttttaattcagggattaaacaaaaaataaaattgtgctctagaactatatagataagtatgagtgtgaaatatgaaaagtggctgctttacttatcaattttggaattaaaaattagatttagatcattaaaatagaaccacttttagttcccaaacttcctcataatcttaagggaaaaaaagttcagtaggattttcagtcaaggagtatggttgcaaacaagcattttatttaagttagctaacttccatacatgaattatatttatcatatattttatagacaaatgagccatctctatctcctttcatatttgtgggaaactcttattctgccaatttgagattatattcattttatggagaataaatattctaatatggctcatagttttaagttaaaagaatggaattagttgattatcacagacattaataggctgtactagtcagactatcattgtttcttttggcaaactaacaagatatgtctatatataaaattgtaaattcctgcattaaattgcataatggtatgaatgtcagtagatttcaactcaatgaactaatcagttcatgcaagccaaaattcctgggtagatgtgctgttactagagatttcagccatttttcaaatcattatagtgaactgtcaatgaaaatatattcattatgaaagcagatacttcccaaatgaagttataagaacagataataaatgtatgcattgttcattagctggatcaggtagattaatttcccaatgtgatattattgcacagctgttttaattactgaaaatttaaagattaagcatatcaagtattataaggatatggctcaagaacctttagatgttgtcaataagatacagggaagtcattcaataaaatcatagagtaaatggtatagcatcttacaaaacaaatcctaagcatatctacccatggtacacaatgaaatgcttgttcacagatattcttaacagctatattcataatatctcacagtggaaatgaacaaaatatgcatcagcatgtacatagaaaatctcagtgatgaaaagcaataaaagggtagtacacttatatgtatgcactcactggtaagttgattttagcctagaagctcagaaaacccacgatacaatccacagaccacgtgaagctcaagaagaaggaagaccaaactgtggaatctttggtttttcttagaagagggaacaaaatacccatggaagaagatacagagacaaagtgtggagcagagactaaaggaatggccatccagagactgccccacctggggatctatcccatatatggttaccaaacccagactctattgtggatgccaacaagttcttgcctgacacatacagaggtcaatgctcacaaccaatcactagactgagcacaaggtcccaaattaaggagctagagaaaggactgaaggagctgaagaggtttgcagccacataggaggaacaacaatatgaaccaaccagtaccccagagctcccaaggactaaaccaccaaccaaagagtacacatgaagggacctatggctccagccacatatgtagcagaggatggccttgtcagtcgttaatgggaggagaggcccttggtcctgtgaagaatcaatgccccagtgtaggagaatgccaggaccacatagcaaagtgggtggattggtgaacagggggaggggagatggcatagggggttttggaggagaaaccaggaaagcggataacatttgaaatgtaagtaaagaaaatatctaataaaaaaatgactctcaactcattgttatacaaaaaaaaaaaacagacataaatgagtgtgtaggcattaacatgaagacagagagagctttagtcaaactcttcagtggtaatttcttggttagagggaaatcttcctgaggtactagaaatatgtagcacattgtatcctacaaaaatactataaattataacatctgaatgaggagaatttagttttatattattctagggctaatcattcacccaaatgagaaagtgaagaaagtactgtttagaccagcaattaatctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaccccaccctggggccttcagtctcttgagggttaggtgcatcttctctgactaaactcataccgagcagtactctgctgtactgtgggagcctcatatcagctggtgtatgttgcctgcttggtgacccagtctgagaggtcttggggggtcaaggttaattgagactgttgtcctcctaaagggtcgccctcctcctcagcttcttccagcttttcccccagttcaaccatggggctcagtagcttctgtccattgtctaggtgcaattatctgcatctgactctttcagctgcttgtttggtcttttggaaggcagtcatgctaggtccgttttttgtgagctctctatagcctcagtaatagtttcaggccttggggcctccccttgggctggatcccactttgggtctgtcactggaccttcttttcctcaggtttctctgcatttccatccctgcagttctttcagacaggaacaatcatgggtcatagatgtgactgtgagatggcaaccccatccctcacttgatgtcccatctttctgctagaggtaggctctacaagttccttctccccactgtaaggcattttttctaatgtctctccctttgagtcctgagagtctcttatctcccaggtctctggtacattgtggagggttccccccaacatcttacctcccgaggttgcctattcccattctttcggctggtcctcaggacttcagtccctttccccaacccaataccagatcatgttcccctctttcccccaccctaaccaccattttctttaccacccaggtccctcccttccttcccccttgtgattgctttctactccctcccaggtgggagtggggtgtcttcacttgggctctttagcttgttgatctttttgaattctgtggactgtattttgggtgttccgtactattttgtctaatatccacttattactaagtatataccatacatgtcattttgggtctgagttacctcactcagcatgatattttctagttctgtccatttgcctgcaaaacccaggatgtcctccttcttaatagctgggtaatattccattgtagaaataaactactttttctataaccactagtctattgtgggatatctgggtagttttcagcttctggctatcacaattaaggccactatgaacatagaagaagatgtgcccctgtggtgtggtggggcatcttttgggaatatgtccaagagtggtatagttgggtcttcaggtagatctatttccaattttctgatgaacttacagatttatttccagagtggtagtaccagtttgcaatcccaccagcaatggaggagtgttcctcattcttcacatcctagacatcatgaggttttgatcttagccattctgactggtgtaaggtggaatctcagggttgttttggtttgtatttctctgatcactaaggactttgaatatttttttaggtgcttcttagccatttgagttttttttttcctgtgcttagcaaaatccaatgacaatatgaagaatggaatagaaagaaaatcatgggcaatgtgggactatgtatactagaagctggaggatgttgatccctcaatactcagagtaaactgaatgagtatggaaatgcatataataaaatataaagcatagtgcccaattcctgaactctatataatttaaagctcctttaaaccccttctaaattatagataattacagaaattttgtcacactatagacatgtttcttactggttgaactaatgggaaggtatttgatagttatgtgtcattcatgagtttttattttaattctcattagacaaagctattacccttagaagtaccacattaaggaattattaagcagttctgcattaaccatcaaaggaagagtggataattacaggatggaagaaaaccttgagacaacttttacattacagaagatcttgagtgttagacagatggaagcaaagcatccatccgtttctttaccattaagaccttgcataggtgtttgtgacatttggtgctgggatggggaaatcagattttttccatctgttcaaagtcttttattatgcttttcagtataattatatctttttagttaccacatgtgattctatttctgtagtttgtgaggattgtctaacaagggcagcatccttatattgtgtactttttataatgtaagctctcaaagggtctcactggctagtaccaagtatgtcataaatgattacttagtaagaaggctgaattatcaaggcattggcaatactttttgatgttaaccttaaaacaaaactcaagataaaacttaaaataaaatttaagtgtttgcctatttaaattttgtgtgtatggttgcttatgtatgtacaaactattttgtgaagtaatgctacattattcatttggaaataaagaatattccatgattttacaaagattccgtaagtgcttactatattctgggcaacttttcttgacacttggggtatttcaatggaaaattatcccagactcttgttttttctagtatgagaatatatgcagaaacaatacatataatacaggttcccaacataatatgatattcagtgataaaaatagaggatgcagacaataagatactattaatcaaagtaataaaatcgcattaataccatctctttgaagtgagaatttaggcttcattgtgtttgttcaccagcatgcttaggtacagtctcactatgtcacagcatgtatgtgaaggtttttgtttgtttgtttgtttgtttttaattgttttttattaatttacatttcaaatgttatcccccttaccggtttcccctctgcaagccccctatcccatcccctctcccgcgcttctatgagggtgttcccctacccactcacccactcacacctcattgccctagcattcccctatcgagccttcacattgatgcctgacaagtctatctgtggctggagctatggggccctccatgtgtactttggttggtgatttaatccttgggagctctgaggactctggttgaaagttttgaaaccttgggtgttagtccttatcttctgccttccttcagacagtgtttcttctattgaacactccagaatagttgacccatgagcattccaggcatttctcatctctctgcttcacatcttcctataggagaattgtgaataaaaatgtgctattatatccacatttatgtgtgttctcaaaatctgaactaaggtcttccacaagtcattttacaaattgaatcatttcctcagcctgcctgtacaagttttatatgcattcattcttcagtgatcaaatgatttttttattagaaatcatcaacatatatgtgcttgatttataattaatacatttaataacaatgaaagtaacagaaaattcaaacaacataattttataacaaattcaagttatgttatcacaggtatttatctaatattcatatgcttgaggctcttatactggaacacaaaggagtattgttttgtttttattaaaagaattctttttaagtgaattttaatccatgctgctatcccattctaatattgaatataaagtgaaatcatcttgtatttatggatattagtcttgaagaaattatactcatatgaagattaatccacattaaaatttcttttttattaaagattacagcaaattgctgaagccaagtttaatgatgcgaaatcactaaacaaagttccccaacatgacaactgagaagagtgagctgagggcaattgtccccttaggcaatgggcaaagtgcccagttacaaactcagttatgaaatctgaactcattcaaccaagaaaatctatatgtagtggtggtgtctattatattcgacttctattcacagccagttttctaagtttaaattcctcttattccagtagtatagaaaataacataaatgtttaaaaacttttcataaatcaaaaagtagaaaaaagaaaaagttatcccaatctggattattagtaactttagaaaaattaaaattaattgtgttcgtgtttttctgttaatagtcagaaatgaaatgtttttccctaacaaattagaatatcttatttcctctacaagaacagataaatgatacttctaattagtgtaggcgtttaacaaaccagtgatagagaaaaataaactcatatttatttactttttgagatgtttttctcaaaaatctcaaggggttcttggagattgagaattggctgtctaactcataataaggatataatgggaaaatattattaagattccaggactctcaaatcataggcaatatttgaaaccaaattaatattatgtcatactccccaatcacgagttgaagatggtggctttgggcagaataattgtatctatcaaccattaaattatcattcataggtctaatactcttgatgcattttcctcttactggtgttttctttcatttttatgactcataaggatttagcagtaacaaatcagcatcaatattttatcatcagcttatacttggtgcctttatctttctttaaaagaaatgcagctgcttttaatatattggtgaatctatgattttatttgtaaaaattaccagtaggagtcaccatgaattatagcaatacactttgtgttactaggaaaatatctcagtggctcccccattcctgttttccagtaggtttatttcttttttaatgctcctttaattccctctctttaaagttcaattttcaaatatatgtgattcttactctgaactataaaatatgggcttaattccattatctttcctaaacatcatcgaaagtccttacaatgtaatcacacatcttgcccataaagtaaatttaacattatatataaatagccgcagctccggtgtcacatgtatttaaaattcctataaaacaatatgaattttaaaggaatagttgtatacattgactgttctaaaaattatttaactttacaaatgatgtcttgtcatctttgtattgaataaaatgcaaactgaatttagatttcaaatattcttaaaaaccagtgcctttattctatatgtagtttgtccttttctatcactctggtaatcctacttctattgattttctcaaaaattctatcaggcaatgaatctttgcttgctcactgccttctttctaatccattcttaatgcaacaaggaaacataattatttttcaaacaaaaaactaatatttttgagcactcacttatttcaaaacaagataaatagatattttatgcttaatccttccaaagatatattacaaatattatcataaaggtaaattcagtggatcattttcctgtttgaagttggtcactaacataaaatgaaaaatcctcatgaccagctaatccatatactagctggtctttgttttcttatttcatctgcctgttccctttctgttcaaaatcaagctcttttccactccagaaccttgattcttgttaatccttctgcaatccactgggcattctctgcctaaaagtttctttttatgtctgtcatgtttaagctcacatgtcacctttgtaaggaaacaatcgtctccagagtagcatcaagagagcacttctcatgtcttccaatactatttattttataacaatttacaaaatcgggcattatttctttgctgttttattgtctatctgtagatctctcgctctccttacaaattctagcagagtggaaacattatctccttcaaagcaatatgctttgaggtcatatccttccatatatactttataatccttataggtataccatgaataatgtattgatgtgtcaaagttcagaagaaatatgaacaagtaccttcttgaaacactaattgtcaaatgttttcagcttgtgaggttattgagttctcaatgaacagcactgaggccagttagggctacataagcccctgactcaaaagaaaaacaaacaaagttagttcaatagtgtcagaatttctgcttattaaagtaacatttcctaccaatagattcaattggagcaaaattttcaataagtctggtattctgcactcaatggttgtgtgaactcccttacaggaattaaagtagaaataaaactctgtaagggaacaaaggtgactaatttgatgaggagaacttaaaaaaaaattaagagttcttaagataaaacacaagacccactgtcttttggtatgatggggtatattttcacttatgtaaaaatacaatcaatatttgaactaaaaaaaaaagaaaaaaaaacataagttgccagagcatctaagggagacatcttggttcccggattccactgagacaagtctgcacaggtgagtgtgtggactacagaagctaacagcttctagaacaggcaggagccacagagcttctgagacagtccctgtttcaggctccagacatccgggcactttccctgccagaggagaggtgtacaccctgcccgggagggctttgcctgagtacctgagggagccatcttggtccctgaatccctctgagactagtctgcacaggtgcaagtatggactacagaagctaacagcttctgggacaggtcctgttttgggccttcatattctgccagaaggaaagtctgaacaccagatattgtacaccttacctgaaagaggagagcctgcctgcagagagtgctctgaccactgaaactcagaagagatctagtctcccaggtctgctgatagagactaacagaatcactagaggaacaatctctaaccagagacaactataacaactaactccagagattaccagatggtgaaaggcaaatgtaagaatcttactaacagaaaccaagaccactcaccatcatcagaacgcagcactcacaccttgcccagtcctgggcaccccaacacacccaaaaaggtagacccagatttaaaaccatatctcatgatgatggtagaggacatcaagaaggactttaataactcacttaaagaaatacaggagaacactgctagagagttacaagtccttaaagaaaaacaggaaaacacatccaaacagatgatggaaatgaaccaaaccatactagacctaaaaacagaagtagacacaataaagaaaatccaaagtgagacaacgctggagatagaaaccctaggaaagaaatctggaaccatagatgtgagcatcaacaacagaatacaagagatgaaagagagaatctcgggtacagaagattccatacagaacatcagcacaacaatcaaagaaaatgcaaaatgcaaaaagatcctaactcaaaacacccaggaaatccaggacacaatgagaataccaaacctataggtaataggagtagatgagactgaagattttcaacttaaagggccagcatgtatcttcaacaaaattatagaataaaacttcccaaacctaaagaaagagatgcccatgaacatacaagaagcctacagaactccaaatagactggaccagaaaagaaattcctccctacacataataatcagaacaacaagtgcactaaataaagatatactattaaaagcagtaagggaaaaaggtcaagtagcatataaaggcaggccaatcagaattacaccagatttttcaccagcgactatgaaagccagaagatcctggacagatgttatacagacactaagagaacacaaatgcaagcccagcctactatacccagccaaactttcaattaccatagatggagaaaccaaagtattccatgacaaaaccaaattcatgcattatctttccacgaatccagccattcaaaggataataacagaaaaaaaccaatacaaggacaggaacctcaccctagaaaaagcaagaaagtaatccctcaacaaaccaaaaagaagacagccacaagaacagaatgccaactttaacaacaaaaaaaataggaagcaacaattacttttccttaatatctcttaatatcaatggactcaactctccaataaaaagacatagactaacagactggctacacaaacaggacccaacattttgctgcttacaggaaacccatctcggggaaaaagacaaacacaaattcagaatgaaaggatggaaaaaatttttccaagcaaatggtctgaaggaacaagctggagtaccattctaatatctaataaaatcgacttccaacccaaaatcatccaaaaagacaaggagggacacttcatactcatcaaaggtaaaatcttccaagaggaactctcgattctgaatatctatgctccaaatgcaagggcagccacattcattaaagaagctttagtaaagcacaaagcacacattgcacctcacacaataatagagggagacttcaacataccactttcatcaaatgacagatcatggaaacagaaactaaacaggacacagtgaaactaacagaagttatgaaacaaatggatctaaaagatatttacagaacattttatcctgaaacaaaaggatataccttcttctcagcacctcatagtaccttctccaaaagtgaccatataattggtcacaaaacaagcctcaacaaatacaaaaatattgaaattgtcccatgcatcctatcagatcaccatggactaaggctgatccttaataacaaaataaatagaaagccaacattcacgtagaaactgaacaaaactcttctcaatgataccttggacaagaaaggaataaagaaagaagttaaggactttttagagtttaatgaaaatgaagccacaacataccaaatctaatgggacacaatgaaagcttttctaagaggaaaactcatagcactgagtgcctccaaaaagaaactacagagagcacatactagcatcttgacaacacacctaaaacctctagaacaaaaggaagcaaatccacccaagaggagtagactgcaggaaataatcaaactcaggggtaaaatcaaccaagtggaaacaagaagaactattcaaagaatcaaccaaatgaggagctggttctttgagaaaatcaacaagatagataaacccttagccacactcactagagggcacagggacagcatcctaattaacaaaatgagaaatgaaaagggagacataacaacagatcctgaagaaatccaaaacaccatcaaatccttctacaaaaggctatactcaacaaaactggaaaacctggaagaaatggacaaatttctaacagataccaggtaccaaagttgaatcaggatcacgttgaccttctaaacagtcccatatcccctaaagaaatagaagcagttattaatagtctcccagccaaaaaaagcccaggaccagatgggtttagtgcagagttctatcagaccttcaaagaagatctaattccagttcttcacaaactattccacaaaatagaagcagaaggtactctacccaactcattctatgaagtcacaattactctgatacctaaaacacagaaagacccaacaaagatagagaacttcagaccaatttcccttatgaatatagattcaaaaatactcaataaaattctccctaactgaatccaagaacacatcaaaacaatcatctatcctgaccaagtaggtttcattacagggatgcagggataggttaatatatgaaaatcaatcaacctaatccactatataaacaaactcaaagacaaaaaccacatgatcatctcgttagatgtggagaaagcatttgacaaaatccaacacccattcatgataaaagtcttggaaagatcaggaattcaaggcacatacctaaacatgataaaagtctacagcaaactagtagccaacatcaaagtaaatggtgagaaggtggaagcaatcccactaaaatcagggactagacaaggctgcccattttctccctacctattcaaaattgtacttgaagtcctagccagagaaatttgacaacaaaaggagatcaaggggataaaaattggaaaggaagaagtcaaaatatcactctttgcagatgatatgatagtatatataaatgagcctaaaaattccaccagagaacacttaaacctgataaacagcttcagtgaagtagctgaatataaaattaactcaaacatgtcaatggcctttctataaacaatggataaacaggctgagaaagaaattagggaaataacacccttctcaatagtcacaaataatataaaataccttggcttgactctaactaaggaagtggaagatctgtatgataagaacttcaagtctctgaagaatgaaattaaagatgatctcagaagatgggaagatcttccatgctcatgagttggcaggatcaatatagtaaaaatggctatcttgccaaaaagcaatctacagattcaatgcaacccccatcaaaattccaactcaattcttcaacgaattagaaagggcaatctgcaaattcaactggaataacaaaaaacctaggatagcaaaaactcttctcaaggataaaaaaccttctggtggaatcaccatgcctgacctaaagctgtactacagagcaattgtgataaaaaaaaaaaaaaaaaaaaaaaaaaaaacctgcatggtactagtatagcatatagcaacagacaagtagaccaatggaatagaattgaagacccagaaatgaacccacacacctatggtcacttgatatttggcaagggagctaaaaccatccagtggaagaaagacagcattttcaacaattggtgctggcacaactggttgttatcgtgtagaagaatgtgaatcgatccatacttatctccttgtactaaggtcaaatctaagtggattaaggaactccacataaaaccagagaaactgaaacttatagaggagaaagtagggaaaagcctcaaagatatgggcagagggcaaaaattccggaatagaacagcaatggcttgtgctctatgattgagaatcgacaaatggaacctcataaaattgcaaagcctctgcaaggcaaaagacactgttaataagacaaaaaggccaccaacagattgggaaaggatctttacctatcctaaatcaaataggggattgatgtccaatatatataaagaactcaagaaggtggactccaaaaaatcaaataaccccattaaaaattggggctcagagctaaagaaagaattctcacctgaggaataccgaatgcctgagaagcacctaaaaaatgttcaacatccttaatcatcagggaaatgcaaatcaaaacaaccctgagatttcacctctcactagtcagaatggctaagatcaaaaattcaggtgacagctgatggtggcaaggatgtggaaaaagagaatactccttcattgttggtgggaatgcaagcttgtacaaccactctggaaatcagtctggcagttcctcagaaaattggacatagtactactggaggattctgaaatacctctcctgggcatatatccagaagatgttccaaccggtaagaaggacacatgctccactatgttcatagcagccttatttataatagccagaagctggaaagaacccagatgcccctcaacagaggaatggatacagaaaatgtggtacatttacccaatatagtactactcagctattcaaaagaatgaatttatgaaattcctaggcaaatggatggacctggagggcatcatcctgagtgaggtaacccaatcacaaatgaacttacacaatatgtactcacttatacatctgagctagagaaagtacccaaggagctgggggggggggggatctgcaaccctataggtggaacaacaatatgaactaaccagtacctcctggagctcatgtctctagctgcatatatatcagaagatggcctagtcggccatcagtggaaacagaggcccattggtcatgcaaacttcagtacaggggaatgccagggccaagaaatgggagtgggtgggtgtcggggtgggtcgggaagcctgtaggggacttttgggatagcattgaaatgtaaattaaataaatacctaatttaaaaaaagaaagtattttaatatttgattataaatataagtagcaaaatatacatacatatttttaaatgtgtttctaaaataatgatcctgtactactgtgaaagtgtccatgactttgaaacagagtaagttaggtatataggagttgtaaagagcccataatttagaagagcaagttaggttacaggagagtttggatagaggaaagggaagggaaaaaccatgtgcaaatcctgttatagtcacaggatttggagacaattttagcccaattgtcatcaaagagacttcattaagcaatggatggaaacagaggtagagacacatagccaaagagagaaaggattttaggagccagaggggtcaagagcaccacaagaaaagtcacagtctcaactaacctggcctcataggggctcagagagaatggacaatcaaggggtctgcatggctctgaccttttccctctgcagatacgttgtggttgtataacttggtctacttatggaagtcatatgtggattctcacaaccaaccattggactccaatggaagagttagagaatggactggaggatctgaaggggtttgccacttcacatgaagaactactaaatcaaccaaccaggcccctcaagagctctcatggactaaagaaccaaccaagaagtacacatggagggacacatggctccagctacatatgtagcaaaggatggccttgttgggcatcaatgggaagagaggccattggtcttgtgaaggatcaattccccagggtaggggaattcgagggcagtgaggtgggannnnnnnnnnnnnnnnnnnnnnnnnnnnnnnnnnnnnnnnnnnnnnnnnnnnnnnnnnnnnnnnnnnnnnnnncaaaaaacaaaaacgaaggagaattttggaaggaattaagtaagtactatgagtgtattctatatgtttcagacatcaccatacaaagtaagttcataagtagtgttcagtaacatgtaattttactgggcccatccgagaaaagatgttctgttgtatctctggctaattaactgtgagttgctttgtgaatgtacttagcaaaaatatttggaatgcaggaggaaggagagcttgtagctttgaaaacggggaacagtgcacaataatatgtcctgtgtctgttcagctaacaaaaatggacaagaatccattgtgtgacagtgatttaattttaggtcataacatttatcaaaatttcatactgtatctttggaagcactatgatttgtctgaaaaaatatgtaattagtaatagtttctgatcaatttatacaattattaataaacttttcatatagaaaaactacatgaaaaaaaaaacaaaaaacaaaagaaaatgaggtggtaaatggtatatggtgatacatacagaaatattatgtgttatgattcagggttttgaaaactgtctttacttccaattgtcctaaaacttgtttgtgttgttggtttagatggggtcttatatagatcaggttggcctcaaactcattctgtaattaagtatgtatgtgaactcttgatccccctttctaatcatgcccattacacccgagttttaaacttaaaccttttttaaaaaatctccctgtcaaagatcaagtgaccataggtgtgtgggtttatttctgggtcttcaattctgttccattgctctacctgtccatctctgtatgaataccatgcagtctttatcactattgctctgtaatacagcttgagaacatggatggtgattctccccaaagttcttttattgttgagaatagtttttgctatcctaggtttttgttattccagatgaatttgaaaattgttctttctaactctatgaacaattgagttggaattttgagagggattgcattgaatcagtagattgcttttgtcaagattgccatttttactatattaatcttgccaatccatgagcatgagagatctctccatcttctgagatctttgatttctttcttcagaaacttgaagttcttgttgtatagatctttcacttgtttgtttagagtcacaccaaggtattttatattatttgtgactattgtgaagggtgtcatttccctaattcatttcttagcctgtttatcctttgagtatagaaaggcatctgatttgaattaattttatattgtggatgccaagaagtgcttgcttacaggagcctgatatagctgtctcctgagaggctctggcaaagcatgaccaatacttgtgtagaggcttgcagccaatcattggactaagcatgggaactccaatggaggagttagagaaaggactgaataagatgaaggggtttgcaaccccataagaagaacactaaccaaccagacaccccagagctcccagggactaaaccaccaaccaaagaatgcacatggagggatccatggctctagccgcatatgcagcagaggatgaccttgttgggcaccaatgggaggagaggcccttggtcctgtgaaggctcaataccccagtgtaggggaattagagggcagggaggcaggagtgggtcagtgggggaacacactcatagaagaagggggagaggatataggatggggagtttggaatggggaatcggttaaggggataacatttgaaatgcaaataaagaaaatatccaataaaaaaatacatgtttcagaaaagaatctctttgttctgtatttaagtaacaacaacttctttctacagttctggaggctagcaatccaagatcaaaggtattggtggaggtgttttttcatgactggtgtcttggtaaacttttatttcttttcttataaaattgtattgatgccaagatggaaatacccctgtgatatagattagacatggtgggttctttttctcagacagataatttcataaaagacagcaaatgaaatcagagtggaacaaaggcaaagcttaatagcaagagttacagactctacaatgccgcagaccctttttggtccctgtctgcatagaacgggtctctggttgctggtggacaaggagtcggtgaatgagtgacagacagaagcaacacaagagattgtatagaatctgagtgtaatttttcaagtcgagcatcatgctttttatacagaagagcgacaagaaatcaggcaagatacatcctctgagttacagtgacacaatacaaaaggaatgtatacatcaaaagaaggtgtggaccaggcagctgccactaagaaaggagccaagtgtaatgttagtctattgttaagcccaccaccaggggttcttagtaaatgcctgattatgctgtttatttgggcctagtgaagaaacctgtctcagggggattccctaactctttcatggtaaacctacctatttgctaggccattgtgaattcccttgtctgggtatcaattttgtgaatcaatgaattatctagtgttgacttttgtttacatttagtgtgtgtgtgtgtgtgtgtgtgtgtgtgtgtgtgtgtagaggcatgcacattctgtggcacagttgtagtcagagggcaacttctagttttctccttccactatgtgagtcctgggaatgaaattcaggccattggacttagcaataatggtctttacactaatccatcttcctagccctctaatgtagccattacaatgatgcttgaatatttttattttattggttattggttatttaatttatttacattccaaatgttgcccccttccctgtttcctctctgcaaagatcctatcctatcctccccccactccaaatatatgaggatgctccccaatccatccatccactcctgcctcaccgccctagcatcctcctacattggggcatccagtttccttaggaccaagggcctcccctcccactgataatgccatcctctgctacgtatgtggctggagtcatgggtccctccatgtgtactctttggttggtagtttagtccctgggagctctggaggatccttttagttgatattgttgttcttcctatgaagttacaatccccttcattcccttccctaaggtatatggagtactcttccaccttttaacttcactgactgaacctaccttccttatgtaagaaaagaagggatggtcattccttcagtctctgctccgaactttttctctaatgccaagggccaagaaatgggagtgggtgggttgggaagcagggtcagggtggggagataggggattttcagagaggaaaataagaatggggataagatttgaaacgtaaataaagaaaatatctaagaaaaaaggaaaggggagtttaaagctacaaagctaggcccctgtgggggaggttctgttgctttctgatagctacttataggagtctacttagaagtcatcttaggaaaccttttctttacaggtggagagttaccacatgagccaataataatggtgtgttctctacttaccaacttattgtctctggataagggaagtaatttgcttttaaacagtgtttctaatccttttcccttgagaaaaccatttcctctcctattcctgggtaagctgatttctcacaatcaggtatgtgtgaaggttttctgctaggcctcttgtgttggtaaaatttttaaataaatctccccaaggttgagtgtaccatagtgaatcttaaagtcccaaacttccagtttactataacaaccacattcttttatgttgtactgagcttctaatgaacagaggctcatgtattcaaatgccaattagaaaggtcctgaaaatctggccagtcactcaaccataatgtgcaaagttaaaatactggttgcctagtcccataagttccattatctcttatcccagttaatagtagcaacatgtatgctatatttaagagacgcacctaagaaccagttttcatttctctttctttcttctgccccataactagtttgccatcatttccatctcatcgtctcttctgctgttcttacatcccatgcctctaccagcttacacccaggatgctgtgttgtattgccacttattgggcctcttttatggtagcattgcttctgtaatcaaaaatttactgctaaaaaaaaaaaaaagaaagaaagaaagagtaaaaagttcatataactgcttccgtgaaaactatcttatactttctctataaccatgaaagaattctttcagctattagctaaaaattgttgcagaaaaccacagaccaccaggttcttgctaactctagaaacataatctttttaccattttaataaaggtaaatcagtatagtataccctcatgatcttttgctgccattgttcactctggctagaaaactttacctccagattttaaggcttaatttatccaaatgcaagttctaagctcaaatatcacaatgcaatgaagacacgcctacaattttattatggggaactcagcaacatatcccaggtatccactgtctaaaccataacttgatttctagtcttcaaagtacctttcataaactatccatttctcatttagttactttggctgttactgtacatttattctgattatcatgatgtttatgcaatggcaagaatcttgcccttttctgctgtgttcacttgccttgatcatgataagaaccattactggttgaatagagaaataaggacaaaattcttcttttaagaaattgagactggaaatggtcacctgaatgtggttgaagacctagctagtacaatatgacttgacagaaatgttctgagagttctagaaattaaactgccttactgaaatctaactttgaataatttattatctaaaaggccactaaactactactagaattaatcttagcatttccaattccttcagcacccttacacttttgctttgtaaatacatcctagaaggaaagaaatagcatcatatttaatagccaggattctcatactttgtttgaccccaactccaaagggaaatgaaattgagttattcaatatcagaggcccagggcagttgttctttaagatgtggctcctgaaacagaaggagcagcacaaagttgatttttagagacagattctgacttacatgaatagaggctttaaatcatttggaacaagccctctgcaacagtaaaagaacaaatataccaagatagcagggcccaaccttggatgtaccttagaataactacccatcaagctttgaaaatttctaatgcttgaataccttttctacctgctttagtttagatgatatgccgttggctggaaatctgttttatttaaatctgatggatttctgaagtttaggaccagagtccaagggtggtcacaggcaagtgcagcatattcaggtcctggaaagagatataatttggaattcaaacaatgtttgcctcttaattctacagaggggtgaaggaaaatgacttggcccaaaacacagcatctggttgtaaatgttagtgttgaatagcatcatctaaatcatcaattcatagaaaagcacgttaaggcagtgtaatgttcaaaaccaagttctgccataagcatctgctataatagattgacttattccagcagagaattttcatttcagggaagcttatcatgatatcaaatatgttttgagttaatgaaaacgcaggaagcaccaagttaatagggcaattttaaaccataaaacctaatttaactgcactaagaatgacaatataatgtttcgtacaaaaggaagtttcacggccttattgagcaaatggaaaattgctaggatgctacatgatagtctcctttgaagaacttgtctaaaagaggcagccttccttagaatatagttatttgcttcttaattaaacacagaatgattaaaaagtgatttcacttttgaaagctatggaacagcttgtttgataaaactgttataactttccagactctcatttccatgtgagtattcattccttatatttgtcttcagagatgtttaaataagggtttttgaggttcttccatatatatttgggttttagtttttgttataagtaaggtatagtttcaatgtcaggaggaagaatggttatattataataaaaagtgtactttgtgtaattttgaagctatccctctctgaaagtaaaaaataaacactatattttagcagcttaatttcaaattatattaaatagctgaaagattaaaggtcaatattaatgaaatcagtctatttctgtcagtttatggatagtttataaaatataaaaatagttatttcattataattgtcctgaattgaatcacctgaaggtttctttagtatcatattaatcaatagctctctaatatcatcctctatgaaacatatttttaaactagtgttggctacaccaagatattagtgccattatcaaacttttaaggacatcttgccctggtgatcattattgtggtttgtaagcagtacatctgggtagagctattgatcacttctcctttagcttgcatagtaccttccagtactataggagttggtcctctgggaaggagtttcccaggtcagtttcagcttgatctcagcaagggttgtatccaaagtctgtggcatcttcagcaatagggacgacttcaaattgtggaagacaactaagtctttatgtttactatgtataataagaacatttctaaggttcattaactcataagatggcttagattatgaatatcaaaactaaccagcccattcactacaacagaagcattagaaatatgctacatataacaatcaccaatttattagtaattaaactttaaaagtttgaaattagactaaaagaatacagtttaatttgaatttaaaataaataaaattgaatattccacatgcaatttttcagtaagacttggcatatttcaaaaaccacatgccataccatttcctacacaggacggtgccaacacagactatgtctattctcacagaatgctctatttggcagtcaatgctgtgtagactattgtatgaggaagttaactatcaaattatttttctcattccattttcattctccaatccccttcatgtacctccttgctcctgcttgaaatcatggcttctttttctttaactgtttcattgcctaaatacataattacaacctcctcagtccatttagcatatgatttcatgcttgaccccttgggattatataaacaattggaggttagttcctggggaagatgatttctctcattcaatatttcttagttttaaataactaaatagatcttttaaataagttcccaatatacatttcttgttcaaagaggatagatgttgtttatctcagttccataaacatttcatcataatgactgcaaagaccatgtactctattctatcaaatgtaatcatattttcctcaaatctctgaagcaatttgtaataaggaatgtatcataaatatttgtcttgaacttaaatggtggcatgtaacctgtgttccactccagtacagagctcctgtctctcatatctctgttcttttgcctcatctcaggaccagccaacctaaatataatcagtcttttcaagcaacatgaatgtaactttataacagtatgttttcagtatggtttgctatctggaccaagtgaggtcagttggtgtcagaaacttcccttttaaatctctgttaaaatttctgtaaagaatccctcactcctttcctttttctttgctattcaataactatagaccaaagtcccttgttagagacacagagacagattcagaaagacagcaatgaggacacggtcagatcagatacacaacagacagactacaaataggctagtactcacaaaccacagacatacacaagacatagaaggggggaattcaaacttagactcaagctaatccaaggggaagagttaagtttcattccttaacatgacacaaatacattttggtgcatctaaagttatctttaatgaatttaacctatgtattttggcttatgactgtttgattctccaaacacaggctatctctgtctctgtctctctcattctctctcaaatacataagtattcaaatacatatatacacatgaaaaagataataatctttcttgctgaaacagcaatctaatattatttccaaacacttatactttttaaattttgtaaggtattaagaccattcacttaaaattaattcaataaatactatggtatttaaataaagagaaataaaaaaaaaactacctcatcagtgagtgttactttaaaacttaaagaataatatacagcttcaccctatgtttcaagaaaaacaaaggttttctaaacttttcctgattctttaaccacaaatctccttttagactagactctatgcatgtaaaagatacagagattactggaaaagaagttgggataggaactattgacatgaattttgtctgaaaatcattccttagtacttagcatatttggttgaaacagatgtttggaagatgttttggagggagcagaactagcaggagagtaaagttatgcctagacacctgttaagcccttctgtgccatctgcttataagaacatacacatgaccttaaaatagtcgctgctttgagtggttactttactagagaactgagaattcccctcctacaatctataagacttacaaagtgtttgatgtcagaagggcactgttgtctgcaagcatgagcttctctgtattttatgagctatgtctgaagtccctgacatttagaaatgacaatgtgtcagggtgaggttccttcacataatcttcctaagttttatcagctttgtgaaatgttacaaagggcctttattcagtatataaaatgttttaactattgagaattttatgctgtccagaaggaaaaaagtccttaatgaagattagtcaaagatagttcagtaatgcttttttgcactaatgatgttctttgaaggtttggggtacaaataaaagattctttagttgcttttattttatactcaacgttcataaccttttaacatttttttgtatgaggtacgtttgaattacccctgggaatgaaggaaaactgtaggaagtttttcattggtagtagacatttaattgaaatattgaaaaattaacttgttggctttaatgcattttatattaaacgtttatgtaataaaaaataatagcttagaatctaagaataccaaaataatttaattgttaatgactttatataatatatctttatgtgttcagtgtggttaagattattggctccatttcagtcccatttatttgaagaatttgctcaatgcatttataaatttttataaaatataggcatggaacaggctactagctatcctttagtattttcatcagataaaaactccatttggtaagaaaaagttggactgaccttcacaactaaactataaagctatttgggaaatacaaaaaaagatgtgttgtgttcatagtatatcattttacctgccatatttggagcagcatcagaggctgggggtagggtagtaccagaaaccgggaaggtgagagactcttaaggactcaatgggggtgaccttagccaaatgcccaacattggtgagaaggaacttaaagagcccgcctccagtagatagatagggcctcaagcagagggacaggattgctaccccacagtcaaaattcctgacccagaattgttcctgtcttaaagaactgcatggacaaaaatggagaaaagactgaggggaaggagatccagtgactggcccaacttgggatccattgcaaggggagacaccaagacctgatactattactgatgctatgatgtgcttacagacaggaacctagcatggctgtcttctgagaggccctatcagcaactgactatgacagatgcagatacttacacccaaccattgaactatggttgaattaggggaaagattgaagctcaaggggagggcgaccctaaaggaagtcaagcagtctcaacttacccagaccctagagagctcccagagactgagccaccagccaggagcatacacagactaatttgagacccctggcacaaatagagcataggtctgcctagtcaggccatagtggaagaagatgtgcctaatcctcaagacacaaagggaaagaggagagctggtgggggcaggcaccctatcagaggcaagggggagaagaaatggaatgaggagtctgaacaggtgagagggtgcgccagagaacctgacagcctctggaacaggcagaagcacagaggggctgaggcagcaccctgtgtgggctggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctgcgtgggccggggacagccggccaccttccggaccagaggacaggtgcccacccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggcgctgaggcagcaccctgtgtgggccggggacagccggccaccttccggaccagaggacaggtgcccacccggctggggaggcgacctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcacagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccatgacaaaaccaaattcacgcattatctctccacgaatccagccttcaaaggattaataacagaaaaaaaccaatacaagaacgggaacaacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaaatgtaaatgagctaaatacctaataaaaaatggaaaaaaaaataaaaaaaaaaaaaaaaaaaaaaagaaatggaatgaggaaatgttggggggcaaatgttggggaatgtaaataaatataacaataaaaattgaaaaaaaaattaatacctaggcagcaataatggttttaaagggttttacacacacacacacacacacacacacacacacacacaagttgaatgaataggaaaggaaaactggatctgtgaagaattcttcaaaaattgtttttaaaacaaaaggaaggttgtacatgaaatatttatgtgtatattaaaaggaaaacattttaacatctcacctatgaattaggatattaatgagtaattggataacatacctgagaaaatttaatttatactataaggacgcatctttatcttcatgtttaaataagagtaatgataattaaataatacaaacaagtaaatccacagaaaacatggaaacatattcaatatgacaagcaatttctaaacaaataacttatataaaataaaacaaatattttcctgatagttttctcaaaattattaggaaaaaaggtaccctcaaacacttctaatcagaataaactagtgtaagatgttgggtaagagcctgttttaacaattcaaagttttgcaatattgtcttaaaaaatagagtacaacccaaacttatataacaaggtatttttcatgctaattttaatgatattaattttttgagttatccaaatcacaaaaaatagaatagctatctgtatttattaagttcaaaagtgaaaatccttaaactaagaagtatggtgttctacttttgtctagaaagtaaactaaacttacttttgcattgcatttcttaaaaatataagataatatataatattcatgtagcataaaatatttaattaaaataaacacatttaatggaactaatcctttaaactgtataaaagtacattaaggtcccgtgtgttactaattttcactagtgactacaaagcttttttatttaaaattgtctggtccataagaacaaatgtattaactgtatttccccaatcacatgttgttctgatttgcttccctttttagcctttacttattatcagattgtaagagtgctgaaagctttccactaagtggctgatttgtatatgtctactcacattgagttaaaaattaatgatgtagtttcacacgtgttaatgcataattctactgtctgaacatgatttacacatgtgcacacacatgaatgatacatcattcagatacagtgaaacatcatttatctctaatacttactctttaaggtctatttaatacattacttataatgttaatctttatgctgtttgtgtttgctgtatataaattttttacataccataccatacatttttcattaagataattctctttgcaaagcatgcagctagatttagcttttattttgtttctgcatcaaaagttttagctaatctttaatttttaataactattatgttaatcatttctttcatatttcctctgtcattttacatgccttttcctgcattgtttccaatgtctagtcttattttcacactttgacatctacacagtgcaggaattatataggaatattgtgtgggctgcattgtatataacatctaaaacgttgtaaatgctgagtaaagagttgctatactctgttagttatggaattatggcaagaaagactaatctggaagggatcaggagtagatgcaattcttttccagagtatctttgacctttgattgactgtgaccccttgaatgtaaaactctctgtaatggaaggacaatgagtacaaattacaatgatgttgatgaaatgatactttaatttttgatatgcatgtgtatgattctaatatagtaaaaatcatttggtaagaatgttctggtttaaagttaatttaaaagagcacaatattttaaccatttatactttgataataattttataaagattcaaaggcagtgaaatgaggttaagccaaaatattaatggctgttgccttggaagaattaggttatagatttttttccttttcttcatattctaaattctctatcatgaatatgcatcactttgctcatcaaggtttttgaaagtgactaagaggaactcttctaaataattttctttttatctttcaattaaatgcttggtttctttctttaaaagaaatccctgatagagaattttgagcacatcaagaaaattgttcagaatagctaagagtcttatggtaagaatgacaatgttatagtccaacattgtcatgatcttcattaatgtttcattcgtgcctagcctgtctgaatggactgagatgaattcattatagttgagtaaataaaaaaaagtgattttctctctaaattagtgtaatgacacacttccatgatgaattttctaaatcatttcaggttataccatcctctccatgagtttaattatctctgtcataaaaaggtttcttaaaggttctttatacaacctttacccatttgtcacagactaatttgactataaagctgttaacatcccattttaatctgatgataaattaccttttaacctatctgaaatggttgaagttaagagagataatacctgtagatgtaaccttaccaaatatgaggagaataaaacaaaaaacaaaaacaaaaacataaatataattttaaccttgaaacctgaccggcatttacataaaagatgagctattttgtgtatttattttttctcgtctcccagtgctctgtgtggcactgttttgattagtctttcttaacacatataatctatctccctataaatgttttaaaaacacatgcttccctttgttagctcctctgtaatgttttactcaaaattgctttatctgaggaagtttcaataataacggaaatttatattaacattttttcttattcatttacaaatttgacacctttctctacgttgttgatccaaataatgagaaaatttaaactatgttctatcttttagtcaaaatctctctataaaatgtccctagactttatcacaagtgtaccctgtcatgcatttttaataagtactttccagtgacaacttgttttagcatacgtaatcaactaactaggtaccaagatttttgcatagtacaataaatagcttatagaatcaaagaaatttgctcttgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattacttgtactatttatttgggagataccaatgtaagagttgaattttctaggattttatgaattcatatgcctttggttatcaatgatatattttcttatactgagttcttttgggtatagtatgtcgtttaaaatttttcattttcctggtggtgactcatgccattaatcctgatacttgggagtcagaagcaggcagatctctctttgttcaagagcaacctgctctacatagtgagctacagttcagcctagagaacactgtctcacaatactcaaacaaccaaaaccaatgggatttaatatgtgccaatctcctcccacaaacacacatttgtttatacaatttctgtggttaccaatgctgaattggtaagtgccttaggaagcaatctaaacgtttcatcaggaaagttctattatctattacccatgtgttattataattcacaactttgtcttattactaagataatgttatttttcctttagttcatcaagctataaactttctgttctttcccagagaaatagaaaaaaaaattttatattttaagaaaattaaagacatggccagacatttcaattcctccttgctatctcaagtttagcttgagcagccttgctccttttacttgctgtatgatttggctgcttttcggggcaggggaatgatcagttttaacagcttgttggccttttgtattctgatgcattcccattacttatgtcttagtcatccctatataattttgctggtgaattaacagtctgtactacttccctgaaaaagtttcccatctgagctacattttacctgtaacttatttcccattgttggcaaaacactaaattggtaggaatttaaagtcatttgctgtttcttagaaattctttatataagttggccctacatgtgttgatgcttggtacatttctgcagtgaggtctttctgggaaacatcctttaaattgagtttacaacagcaatgaaaaaagcaatagcataaatctaaatgtctcagaacttttcaaggcaaaattctcacatgatccataaaaaattaaaatgtttttgcgtgcaaagtcagaactcgagggcctaaaatgaggactgaatggttttgtttgactgaacgttcaaagatgtggtaggattcagggtaaggtggttcaagtgatgctatcattgtttctattcttgttttgtaatttgaacctcagcatcagctgagtgttagtattaagatagttagagctgccttaagataatatctatattcagaatatgaggaacgatctttttctatgaacaccttttagaagcaagatgttcactaggtctccagaagactttttaaactttaagtcaaaatgaagtcacgttggaaagaatttcagtttctcttggggcatatggccacctgaacttaggaaaacatctgatcaaaatgctctaggttttaatagtataatgcagtcaagacagtgatagtggcaaggcaacactctctattacctggttccttcatcataatcggtccctgtaaaaatacataggtaagggagagtcaccgtaggcaagctgcaatgagcaacatgtgtttgtaaatatagctggaggacaaaggaagacaatgacaatgttcatattttacccttaagttaaactaattgatagaattccttaacaagtagaacttcagaaatttgatttaagttctcaatacttaaggagataaagccatagttaactatgcagggcagtatcttatattgataaacattgaatctatcactaaaatctgtactaccataagtttcacaacttagccgcttaatttctcctcatttcagtcttatgaagtcattaaacataactgtcatataaactgacctttaatttgattaggaaacatgaatatgcttagggatgaatcacaacaatgcattttagatgtatattaaagatatatatttagtgacaagatattttaactgctatgagtttaatagtaagcagaccatcttctttcattcaatataaaacataaagtggcttatgattataattcttcatgaagctagatgagtatagatgccacctagagagaaaattttcctatttcaacaaaaataaactaaccataaaatatactcttgtggtaaaaatttatttttcgttaagaattataatgtctgggacagctcaatgctagttgcattccatttcactctcaacttctcctggtagataatctactccagtgtgttacatatacaattgtccttaacatttaaaagcaaaagcaccatcggtttttaaaagacactaacattatcagcaagtaattattgttactattcagcattagttctcttattaaacactacctatactcactggggctaaaccaagaaaaaaaaactattgatatttcaattataagtgaacatgaagcacttacctttctgaagtagggttgactttctcagtatgatttgtgagtgtgtgtgtgtgtgtgtgtgtgtgtgtgtgttcattcatttatctgtaaatgtcatagttttactttgccttatgggtgagtaaaatttcattgtgaatatgttcttcattgtcattatccattcctcagttgatgaacatccagtctgattgaattccctagctattataaacagagcaacagtgaacatatctaagcaaatatctctgaaatacagaaacctttgtgtatatgtctttgatataggtgtgttgaaaggtagttgcatttttagctgagaaatctctacactgatttttatagtgactgcaccaatatgcattcccaccaacaacagtaaataaaggatcctctttcctgaaaaccttaccaacttttgttgtcattttacttcttgatggtgactatactggctagaatgagaggaaatctcattgtagttttaacttgcatccccctgagagctaataatgttgaataatttttaaaagtatttattatcatttttttatattttgagaattctatattcagtccaatgtctcatcctttgttgttgttgttaaaatatatttatttattttacatgaatgcatgtatacttgtacctatgaagggttgtgagacaccgtgtgggagcggggaactaaactcagatctttacaaaaagtcagtgttcttaatcactgagctgtcttctccagtccgatggctcatgtttctttgattgttttattgtttggggttttaattctttgtgtactatagatattaatctgttggaaatgaaactggattttttttcttccattctgtggtatgccattcactcaattgacagtttcctttactacacagaatattattggttttatgagactgtatgcatcttatttccagttactgaaattctgttgaggaagtcatcacctgtgcctatatattcaggacactccctacttttacttctagaaattttaaagtatctagtattatattgattcatcatggttcatttggaatagagtttttgtgcaggttgagagacaaagatctagtttcactctactttattttgatatccaattttccccataccattttttaaagatgctgtcatttccccctcccgtgtgtgtgtgtgtgtgtgtgtgtgtgtgtgtgtgtgtgtgtgtgtgtttggcatatttgttcaaacatcagacaactgtagatgtatggctatacagacatgtatatggttattatcttctattgatctgcatgtctgtcactaggtcagtgttatgctgtttttattgctccagttctgtagtagtacatgatatcaggtgtgatgatacctcctgcagtagatattttgttcaggactgaactggagtatctatagagctaaggaaactagaaaatggtcattgggttagaaattgccttgagagagagagagagagagagagagagagagagagagacttagtacagtttattcaaaatcagagagtgggactttgggtatgaaaagttttaagcaaagatgagtgtggggttagagaaataaagagggatgtaaagttaaccaaacctaagattgtatgaaaaagtcatacggaaacttgctaagttttaaaccaattttaaaagcatattttttaaaagggagttagcaatgatatatcctgcatgtctagagtgttgtttctgagacccagggggtactcaaaaaatagcaacacatataagacatctctttatgagttgtctgttgctcaggacaactccaatgtcccccaaaacaatacaggctctcaccactcctcttgattttccatcagaacatattgataagaccctattgctaaagatactgcatactttgtttacaagatataaagaaatgaagatggagatgagatggaaaattcctcccagctggctaactttcatagggcagggagatgttatacaggctgctagggagaaagggcatcagtatcagttgtcttacccaactctgaaccctacaatgtataacaccaacctttcaggcaagatatgcctactggtacaaaagtagcttggctgctgtgaggataatgcaccatagatttgagccctgttcataagagtggatccatacctgttactgtaaacccagtcaagagctcatggctgggaagatctccaagcataagtttcaatttgctaaattgtcgtggcactaatctgctttctaaatgtttatgtttgtactcagatagaaatggactagcagctttaatctgagaattggtttacgatgaatggtggtgaatgaagagatgttcaatttgctaagaataactgtttaatgttaagtctttaacaagacatttatatcacccactggaagactcaatgaacatcatggaagaggaggcagctagagtgtaagaaccagaaaatagggaaagatgctgttgtcttctgggcatgtaccatccagtgcactcatgacctcatagcaataatggcaggctgccatagacctgcaaaaaaccggggcctatcaatagtgaattgtgaaatagagaggaacctatggctccttacccttgactgatgaactactggctaacaattggttctgggaaaggggaaataaatctttgtgtttagttgggtacccaatgaggagcccaccaggttcgaatagatggttctaactcatagtcacacaatggttggatttgtcaggtctcacaaaatacacaccaccaccaccacaacaacaacaataacaacaataaaacaaaatatatgaaggcaaagatgaaatttgtaaagaagaggggagtagaacagaggtaggggggcaatttagggaagtatgataatcagaatgcatgatatacatatctgaagttctaaaaataaaattgtaaaaatttttaaaattaagtttcaaattttttctggtacaagtgtgattttaattacagttgagataaaaatatcccagagagatattttatcaaaacattctcagtacagataaggacactatatttaaaaatatgtttctatcaaaacatctcataattatctagtcacctacaggtaaaatagtaatataaagattgatctatattagcataaaggtaattatgtgccctttcaagagtttaattattcacttaatctgtgttgtgatatatgaaaagtttattatcatagataacaccagtctttataatcatatatcacaaaatagagatgaaatatttagggggtcaatgatatatagatgtatttttcactggtagatatatctaaaagtcaacaaaacgactctaaaattgttcctattaattttgttttaattttttattaggtatttttctcatttacatttccaatgctatcccaaaagtcccccatacccacccacccccactcccctacccaccaactccccctttttggccctggcattctcctgtactggggcatataaagtttgcaagtccaatgggcctctctttccagtgatggcagactaggccatcttttgacacatatgcacctagagacaagagctccggggtactggttagttcatattgttgttccacctatagggttgcagttccctttagctccttggggactttctctacctcctccattgggggccctgtgatccatccaataactgactgtgagcatccacttctgtgtttgctaggccccagcatagtctcacaagagacagctatatctgggtcctttcaacaaaatcttgctagtgtatgcaatggtgtcagcgtttggaagctgattatgggatatggatatggcaatcactagatggtccatccttttgtcacagctccaaattttgtctctgtaactccttccatgggtgttttgttcccatttctaagaaggggcaaagtgtccacactttggtcttcgttcttcctgggcatatatccagaagatgtcccaaccagtaagaaggacacatgctctactatgttcatatcagccttatttataatagccagaagctggaaagaccccagatgccccttaacagaggaatggatacagaaaatgtggtacatttacacaatggagtactactcagctattataaggaatgaatttataaaattcctaggcaaatggttggacctggagggcatcatcctgagtgaggtaacccaatcacaaaagaactcaaatgatatgtactcactgacaagtggatattagcccagaaacttaggatacccaagatataagatacaatttgctaaatgcatgaaacctattattatttttaatggagcaattctttctttaagccaaggtttatgagacagtccaatgtagaataaagatgaggcctgttgattatagcagagatagtgcagtgagtgcagaagctgatttcttagcttatttgcactctcaagtagtcacaagtcacccataaacagaattcttaggactgcaatgagactctggtgatttaatttgttctaaccattagacttacttggggctctccactgggccaggaattaggaggagtaacagaaagcaacctgagcttcaaacttcatttatttaactgtccctgtaatccatgaaggatatctgattgcttaaaaagagttcgtatttcataatcaggctttattaagatttccttgttgccgggcatggtggcgcatgcctttaatcccagcatttgggaggcagaagtaggtggatttctgagttcgaaaccggcctggtctacagagggagttccaggacagccagggctatacagagaaacccccctgtctcaaaaaaccaaaaaaaaaaaatttccttgttgcatctctgactcacatttgacagatttgacactgtatgaagttaacacttctaactaattagtacactttagagttttctctttctttttctttatttcccaattgattttccatctcttttgtatcatgtattactggaaattccatttagacttgtgtgtttggatgtactttattgaagaccatttatatagcaggggaactattttgagaaatgcaaagaaccataaacttgataggaatgttgctctgaagtgatgctggtgatgcataatggcttctctataatactggtgtcttccattgcacacaggtaaactaaagtcacaaatggccttctaaggcatactataaagagggttagatattggaatggaaaaactgaagatcacaacagttttagttatgcctttttattttaagcgcctgatatcaatatttaaagctacatttatctaaaacatgccatatttcacactgtactaactagccattctatggtcattgtgcatatatataccttcttatattataaaatattaatattatttcactttactatgaggtgtattatgtctaagtattaagtattatattttggtattattaccaaaccacagaccaaagtcaatataaagctaatattcataatcaatattatgtagttttccactcttcctctgagtagcattatttccagttcactcagggttctctgctatatttatttttaattttcactgccttttattttgttacattcttttgtaaacagttttatttatctcattttttacactccatattttatctgttccttgtctaccctctgactgttccccatcccataccttctccccacccgtctctacaaggatgtccacacccccctcacacaccctaccccctcatacaccctacccccctcacacaccctacctgacctctagactccctgggacctccagtttcttgagggttaggtgcatctttcctgactaaacccagacccaacaatcctctactgtatatgtgttggaggcctaacatcagctggtgtatgctgcctggtgttccagtatctgagagatctcaggggccaggataattgagactgctggtcctcctacaagatcgctcttctcctcagcttctttcagccttccctaattcaacaacaggggtcagctcagcggcttctgtccattggtttggtgcaaatatttgcatctgattccttcagctgcttgttgggtatttcagagggcagtcataataaatccctttttgtgagtgctccatagcttcattaatagtgtgaggccttgggacctccccttgagctggatcccactttgggcctgtccctggacctccttcttctcagcctcttctccatttccatccctgcagttctttcaaacaggaacaattacgtatcagagatatgactgtgggatggcaaccccatccctcacttgatgccctgtctttctgctggagatgtgctctacaagttccctctccacactgtcaggcgttttatctaaggttcctccctttttgtaccagagacctgagaggtgagagactctgctataaatttttgaaaattccattttcaaatgttctgttttgaacattctgtttttttgattcggccctccctctaaaatttgtcatttgacttgtagaaattctgttgtccctgaatggtatgagaaaagtataaattgtttgtgtttggtgttaagtattaagtaatttattatttttatttaaagatttgttttatgtttaattgcatgtaggtgtgtaggtgtgtaactatgtgtttgtgaggtcagaagatctggatctcccaggaactggaaaaataggctggaaactcagatcctctgcaagagcagtgattgctcttaatagccgagctgtctctccatcccccaataagtactttacaatactaaatgcacaaactttgagaacataaaaagaaacttacttcatgcaaagaataacactatgaataccaaagatttagggtgcagtttaggttttacagttggtaacttccatgtgttaaccactgttttaaaatggcatgagtctttacatgttcataattcatgtccactgatatatttcctccaacaaaggccagatctccaaaacttgtccaaataatgccaacagtgaagaacaagtattcaaatgccagaggttatagggaacattatcattcaaaccactaagggatgtcaaattgaagtatccatcaaaaagattacttttgctatatgtagtgtgtatgggggtgtgtgttacagtggacgatgaagaagtaagtaaagaatacaattgttcatgtggaaggagtaaataataggcgaagtgaccaagtacagttcctagagtgctttttatagtcttcattggtctatttgtggttcttttgcagttttccttgtcttctgagtcttggactgaccccattttttctagaatgcctttttctcacaagaaagtttcagaaatctcaagttcaaaataatcgccattattctaaaacagaaacaggtggaaaaaaaaaacccgaaatcaaggagtcctagaagcacagaagtgggaaggggatggagatttccaggacaaatccataatgtcccactttctccaagtagctcccacctcataataatatcatcacattatgagtaattgtttatgtcatcagagccttcatgatgcaaactcatcccaatgactggacccatcagttaaggactaaaacctcagcacagagctttggggggaagatggcatgtacaaactgggatgtttatgttgcatgtcatgttcacaactttaaatagctgctgttagttatttaaagtaagtggtaagcaacatcaaacaatgtggatgactaggaaaactctattgagagagtctcagaaacagtgtgccttactggactctgatcagtattagtagcatcattccacattgagagctgctattttatgctatcaagcctaagatgtgttatagataattaaatgatctcacttatactatgtcgagagatagttcctgaaaaaaatatgccttcaaaacataatatctttgacttatttaattatacttgggatccaactcaattcaaagccatgtctataaaggttgtcgtttagtcagctaaacatctaaatgtttcattactcctaaggaggaaattaaaagactaatttccctaacttgtaatttcaggtgcagattttgtttatagtcttccaaaaggaagtgtctcactgaagaaaaattaaatgagagccttaggaaggatatttgaatactctgttttctttttccaatcctgctttaaaatccatctttcttaaaaagtgaaattaatttgtggaatgtcttcttaatagtagcttaaggggctagaaggaacctaaaggaaataaattgtccaaacacagctattaggccatcttcagtatttttcaataagactggaaacaggtaagaatatatgcagagaaggataaataaaccaactaaaataattgcatgctctaattatccagtagagacaaccaaattttaactgtagatcttttacttacttgtgtttgaaaagaattttaactgaaatatatttacatttttggtattgctatttttctgtcaaagattatttctacacatacaattggataacatgtctttaaagagtctgaacattaatgagccaaatactttgaaggcctcttagactgccagtgatgacacaaagtggactttgtcttcagaaaacaattatccataggactagttggtgacaagaaggactttacattcccaccttatttagctgattcagaattttataaacttcactattaatctgtgaaacttttcatataaaattcaagtcttctgctttatttatttttcccttgtgtaccagttttttgcctacatgtatagaagtgtactgtttttttaacaagtgtttattacatactttcttcatttacatttcaaatgctattcccaaagccctcctataccctccccctgccctgcttcccaacctacccacttccacttcttgaccctggtattcccctgtattgggcatataaagtttgcaagatctacgggcctctcttcccaatgatggccaactaggacagcttctgctacataggcagctagagacacaagctctgggggatactggttagttcatattgttgttcctcctatagggttgcagaccccttccgctccttgggtactttctcttgctcctccattgggggccctgtgatccatccaatggatgactgtgagcatccacttctgttatttgccaggcactggcatagcctcacaagagacagctatatcagggaactgtcagcaaaatctttctggcatatgcaatagtgtctgcgtttggtggctgattatgggatggatctctgggtggggaagtctctggatggtccatccttctgtatcaactccaaactttgtctctgtaactccttccatgagtattttgttccctattctaaggaggaatgaagtatccacacttttgtcttccttcttcttgagtttcatgtgttttgcaaattttatcttgggtattctaagtttctgagctaatagccacttatcagtgagtacatatcagccaggaagcagaactgagctccagacatctgcacacttttcctgccagaggagaggtggcctccagggagggctctgacctccgagcaggtgagagagccatcttgtatcccaggtccctcagagaccagtctgctcaggagagtgtgtgggctacagaagcaacatagcttctgggacagggaccttttcaggccttcgtcttcagcccaaagtgcaatgtttttatgactgatgctttaagaggccagaagaaggcaccaaatcccatgaaaatgaacattttaggtatcagagaaattgtggcttcatagaacaaattgggtagaataccttctgtttctattttgtggaatagtttgaagagtaatggtattaggcatacttcaaaggtctgatagaactctacaccaaacccatctggtcctggttttattgttgttgttgtgttttgttttgttttttctttgtttgttgtgggttttttttttttttttggttgggaaactattaatgacagtttctatttctttagtggatatgggaatgtttagatcgttaatctgatcctgatttaactttggtacctggcatctgtctagaaaattgtctatttcatccaggttttccagttttgttgaatataggcctttttagtagggtatgatgattttttggatttcctcagattctgttattatgtctctcttttcatttctgattttgttaattaggatactgtccctgtgccctctagttagtctggctaagggtttatcacagggtgatatcacaactgatattgtatataattctaaaacagtagaagaggctgatcagtagacaaaagtaagtaaatatctcctgtcttattatttcaaataaattataaatactattgatgtaaactaattgatgtgtgtcactgagtatcttagtcaaggtttctattcctggacaaaacatcatgaccaagaagcaagttggggaggaaagggtatatttggcttacacttccacattgctgttcatcactgaaggaagtcaggactggaactcaaacaggtcagaaagcaggagctgatgcagaggccatggagggatgttctttactggcttacttgctctggcttgctcagcctgctctcttatagaaccaagattaccagcgcagagatggtcccacccacaaggggcctttcccccttgatcactaattgagaaaatgccttacagctggatctcatggaggcatttcctcaactgaagctcctttctctgtgacaactccagctgtgtcaagttgacacaaaactagccagtacactgagaaaggcaaaaaatttgaagaataaagttgagatttttgtcttaaaaatattaattacatctattcactaaaaaaaatgcttagtattctcttataaagggaaagaactccaaataatgagacatttcccatcatgtccaaaccaaaaaacataagatcagttattaggttggagaataaagaagaaaattctgggatgtgagtaaggaattggaggcaggaaaaacaatatatagaaaagaaaagtcttactaatattcctgactgcctgtgtcaaagacaactggacaatatttgactgagacaaattataacttacagtgcagtatgaaattggttgtaccaaaaacatgacaaataccacccacactgattactaatcaaacggaattcacttctcaatgccagagtttgttttttgagtaagtacagtcttaggtgtgtgtttttggttttggtttttagcatgcatgcaaatatttttttttctatcttggctctttttattgcttgaaatctcccccttcttttctctgtaatgaatatctgttgttcagatattcagatatctgatgttcattctagtgataaagagattcacatgtgtttggtgcatactgctcaagcctgtgacatctaacgaggtgttattcattaataacagctaagaagaagctcacagataaataaatgccatggttgctgatggaataggatgcaaaaaatgttgaatgtattatccattgctttgagtataaatatcagaaaaaatactatgtattttaaacagtcttttttattaaattccatagatataaaataaccatcatagtgatgctaagtacaaatttccaagcatacatactctttcagaattccagaatactgtatttaagaataatataaattactaagattttatatgcattcataaaatatacatgcagataagaacataagtacttgatttgtagattacattagatagatagatagatagatagatagatagatagatagatagataaatagatatatgatagatagatctcttgtattaagtggaaagaaaagagagataattatatttaagtgactaaatttttaatcatgtttagcactgtttttggttcctggataatttttataccttctttttatgaaatcttttttttttttacactccaggttttattcccctccctgtcctccctccaactgttccacatcacatacctcctcctccatgccccctgtctccacttggatgtctacatgccacacctcctacccaccagacctctaaactccctggggcctccagtctcttgagggttaggtgtatcttttctgactgaaccgagacccagcagtcctctgctgtatatgtgctgggggcttcatatcagctgatgtttgctgcctggtttctggatattttaactcatgctttgtgtcctccagagctcagttgcacattgtgtgaaaggtctattcaaccaacaacctctactgtgaatcctttaaaggacactttcccacgccgtcaattaatacatttaagagatgtataagcaattcatgataatctcaacacactgaaaatatagaaagctagtaatatgggtctcaaatttctcgttagaacacttgcgtttattcttcttggggattactttagaaactgtaaatattcctaaagtattaaataatccttactcctgaaaaaaattcagattaatcttaacttgctgccatatgaggaataattctaagctatttttttcctgacatctcataaaagagcaataatctctgagagcagtctgatttggacatactttaggactgattatgtttgaactaaatgtacttttgatcctcttaaaaatctctcaaacttgtgaaaaagatcatccatgttctatctaaaagaatattctctacagagacaaagttcgaactgagaaggaaggaaagaacatccagaaactgccccacccaaggatccatcccatattcaaccaccaaacctagacactattgcatatttgcatatgccagaaagattttaatgacaggaccttgacatagctctctcttgtgaggctatgccaatgcctggcaaatacagaagtagatgtatcaatacaatgccaaataatatacctgcaattttataactctatcagcataaaacaatttgagttttgaatatccatccatgctgcatagctggttgaggaaaatcattcagaactcctaatggacaattcctgtcatgtttttttcatgtactgatatatttaagagtttttgatgtgattctatctatattttatactcttggttatcttgtatcagcaatatatataaaaccattcatgtttcctattatgacacatgtataaagtccatatctcagagctgtatatcaaagtgccaaatataataacacaataaagatctgttttgacactaatatggatttcatgtttgtttcatggcccgtcggccacacattcaaaagcattgtagtactttattactaacagtccagaagcaaaatccacatgatctgtctaatactttgagcccaatttatacaatgcagaagtataccttgcttttcaacattttgcattttactgtgtaccctgaatttttagtgttaatgtgctatattcttcaaattcaaaagtggcctgaaggtaaagtgagagatatttttaagaaagttctcttagttttccaaaaaaatttagaaatatcatttttgcccagacttacaagaggactatacaccttttcttgcattttcataaaaattatgttaagtgatataataaccctagtaggcaaattgtgttgttgtctgtatcacaggtaataacagtgaaactcagagatgtaaaaggatgctttcaaaattagcactaatgtaatcatattttgaatctgacaagtctaatttatgaggtcacagttcctgacagatcctttctagaacattcaaatttatgatgaaagtaaaaatacgagtcagggtcctcagatctattaaggagtccctactgtatattatgaatcctgccagacagcatcaacaatctttcttactttctgtatcagccttattagttaaagaccagtgttactctattttgaaaatattgtttaaaaagttcagctggtaaatgttaacaatagaaaagtaagaattttgttgttgttgttttgttttttaacaaagctggtaaggaagaagcgctagctgtggattctcgatattcattctgcttacataccatctctagtctcaaacaaaacataatatgaaaaacattgttggctaaattgcattggctacttgatattttattcctttatgttagtatttatttattgtacagaataatgggcttcatcatgacatttcatacatgtatataatatactttgatcagttccccgttatatcctactcttcactctttctgatatttccatatttttggattgagaaagcaagatactaaaggactttgtgtcaagcagaacatgtacttttgtgcttctaatgttttcaaaccacattgaatccattttagcagcatcctgtcttaaatttttcttggaaattgagtgacactgttagtattttgaaaggcactgatatgaatgcgtattatatcataagaatagacaattagagaaagagtctgagataaagtacctgtccacaggctgtaattgcagttggtaattaaactgaagtgtttcattttctcactcagctcatcagtgacactagaaaataaacaatttggaagtaaaacccttgggggcaaacaatagtaattaattgcattttccaaaagaaaaaaatatgtcttccccaaatctatttgggatgaacccttgagtaacatacccagtgatttacactgtgagcagagggtggggtccagaaccagacctgattggacttgaatattcatgccatctccagcttgatttatatttcaaaccctgtcttttgtcaaaatttatttctgcctacggtaaaagtgaaggcagatttatattctgaaatactcacagcacacgatgagataatcagcatgaaaagacgttacagcagtggaaacacacactgtgggactgtttctagtttcttccaacttgcaatctcctcaagtatcaggaacactttttttttcagatgtttcaaaggttaaataaaaatatttgtgtatataaattcaggtcccatcccatgtgtctagtagattagaatcattcagtctaggctgtctgctttgccactgttcacttggacagaaaggagttgtgttcaagacttgtgcaccttttgtttgtcacttttgatcacatggaacagacatcagttacttagctctgacttattctgcttgggttgatgcctgacctgaagtaagttttatttctttatcacatcacttcattttgtcaagtgctgtagtactagtttctcttcctggttttcttatgatatgaacatgcccactgaattagataggcatggataagagccaaggtcccataatatactgtgtattatttagattttaccatttaacagtctttagtgctttaaaataataattgtttgttaagcttatggttgtgcaagacagcttttgagtctggagtggaacttctgtgttagccgaggcttatcagatctcaacagatgtatattttagcatatgtaagtagcatccagcttggatatgtgtggacttctctgttgcttccactggaatggtgctttttggctccaatcaattttttaaaaattttagttggcatttcaaaatggtgatatgagtagggattccaaactcagaaagagactcctaatttaaatgaacaaacaactttggcgactgctgcaaatcccttgattacctttagagacaaatcttagtatataaaaaaggcaaacaaaagaaaaatcataataccaagaagcataaaaacaatcaaggactgttaccacaataattgactatatacacacaaaagaaaatacaatattctcagttccagtttcagtattattttaagaacttaaattactatgtataaatcaatgaaaaaattgtttgatactgaggaaaacatatactgacctccccttttcttttattgactatatgaagtttaatttttttctaaattttattaagactataatctttcattttaaaggaattcaatgaatccttaatagaataaaaagtgtaagtaatataaaactaatcattataatgtttaggaatctgtcaactatctacctatccatttgataaagcaataaggaaaaaagcaagatttactacaatacagggcaggggctacttctacaaagcctaactaagcatcttcaaatactttagtatattatttttctcaagtgaactaaagaataaggatttgttattcattattctgcatttacatgaaatatacatatacacatatgtataatagacatcaaagtaatgtagtgcagatgttcttcttatgtacttacaaccacataaactatttccttcttcttgatattgttttaaacaactgtttctaataatgctccacctccactaaataagacaactgcaacgatagtagaatgtcttggctactatcacctactttggtctctccattcctatggacactgttaatgtttgtttctcaaacaaacaaacaaacaaaaaaaacccaaaaacaaaagagaaaaaacctctcatcttacattcaaacaaacaaatgtggtctgtagttcctacacaaagaattgcatttgagccagctgggtcataagacaaatactggctttgaaatattgaaccaatggaaaagtcctgattcaaggttgaaatgacaaagacttttcccaccctagacttcagtgcctcagggcagtcattatgccacaatgaagatacctggctttatctatccaatttgagtctgaatgtagggcatctagacacctactatatgtatccaaggcacactgcaagacaggggtagagtatgtcttgaggattgatggccaacacagccaaggtaatggggctccctcaaatgctcagtatatatttgagccttcagaggtctttctcttagccttggcagcactaaacacatttggaatcttttgtaatgaattttctgttctacatcaaagacaggatgattccatgtcattctgaatcattagtattgaacacagaaaatatccaaaggtacaagctcatgaagtagatttgcctaatgccagggtccttcatgtctgacacaaacacatttaaaatgtattttcttttatgatatgtcctgtcacaatgttcaccctggcccatatgatttcaggctctctctgttgttgaagtttgcaggacaacactgctcaggacctgacagtgtttttttcttcctgggatatcattatttcttcatgcacatgttcagtatattttaacacttgcaggattactgattactacatagatcatgtcctccagaaaacagttttgactttcctttttgaaaaattccttgtactcatggccttgcacctaggtggacctctatgagcctagtcaaagcccatcacatgttaatgcttagcactggactgagctcagaccaacactaattgaaagcaccatgttctaggaagagatgcacatctgaggcagacaaatcttgtgaaggatctgagctctgtcatttaatggcttagacaagtttctttattacaattagcatgttgattaatacaaagcaggtattttaatacaaaaataacctcattatagtatgtcttccaactgatgtatagaacattttcattaagtttgacatcaacatctcttttttcctaaacaatttcatgtcaacctaaagtcttgcagattggttgagcttaatggttccatttccaatgtattgatcatgaatatgtataaatttggcaataaaagagcttctacaaagagctataattcttaaaacatccatggatatttacaaaaagtatttgcatgagaactaaataattgttgaatcacgtatttaactcttctttatttccttacaacctactaattaatcagagaaaatctgtcctaatacagcccatatattgcatcaagggtcagactagatgagatcataatgggtcagtttccaaggtattgattatggccattgaataggctaagacgtttaagtcagcttgacattataatcaaataatcaaaaaagcccttaaattgaattctactttggcctgattgtctttaaaagctagctctgatattaatgcacggatgttcacatctttaatttggaatgaggccactgacacaatagaggagatgaggttccataattttcaagtgcacacattctttttctcattgatctgtagataatagatcactccattggctccactgcagcattcacatttagcctgcctaattcaaattggccagtaaatggaataccttgacctgaaaatcacataaacgaagactcttaaaaatcccaagagtactggattcactttatttattatgtgaaatgtacaacttctttctttctctaaaatactacattacaggtcattaaagtaatatagagcactataaacacatacatattctttcatgactgatcaaacctcttttatctttgctgattctttctcaaaaaccaaaccaaaccaaacaaaaacaacagaatattggtcatcatggattaagacaaagaactgtcattaagattggcagtactagaatgaccattcttggttgacaacaggaatagtgaatttaggatgaatatgttaataattctggttgcctcgaaatacatattcaaataatagcacacacacacacacacacacatatatacatattgtttgatatgtgcaatttttaaattataaacatttgtgtgtttataaagtttgtaaatgatctttgtaatcaatttcgtggaaagcacataattggttatttcaccttagaggttgagattaaaagattatgattttgtttttataattgaatcaatcctttcttattgaaaagaagattctatgctgggaaatgttgtatcacatctatatttctttccctaaactgactaattcaagtacatgaaattttaccatcatacaaatattttaaagcataaaagaaatgttagcaggatgatgactgcttcatgaatatttattatttgttattttaaaatataaaatatttgcatgaagtcatttatacattgaccaaggaaactcttataaagacacacatttaattgggccacttacagttccagaggttcagttcattatcatccacgaattagctaagattgaatcataatactacatgaataccacaagatttgctgatcactgtttatagcaaaatcctttccctaaatataaagttgttaaatttattccatttaaaggcaggcataggttgacagtttacaaagtacttttaattcataattttagaagtttgaccatattaaaaaataatgtttttatttgtttcaaagtatgacaataaccattctggagagaaattaagtcttcagtctatttgaatatcttgagtatgatattaatttattatgttgctatgcttgatcttatcctaaattctgtttccatgctaaataagttgtatgaacacaataatctttgaattataaaaatgttaagggaatcatgtcaaattttatggattcatcttttgtcttattttgaatcttattgcagtgaagagacaccatgaccaaggcaattcttataaaggcatgcatttaattggggctggcttacagtttcagaggttcagtatcatcttatagagttaaaacagtattcatactaaatttaaaatgccttactttaatcatctgcattattcatctaaaggtatatgcatagcaagatattggtctgtgtccagtgatttattttcagtgtatctagttcctgatcataacaactttgaagttttatagttcaaagtactctgtttacagttcaatggagtatttaatcttgtccttatggatagtatgtactctcagggatgatatttcagaacatagtacaaagtgcccaatacaaaacatcacttttgtcactagcacttactgtgttacctgtaagccatgagattgtgttcttcttttcctgaccagattaagatatgcttttatgtctattatgttattcttctatattacaaagctgaaatactcctggatttcactaggagaggataaaaactgtaacagttataaatattttactatagactgccaggtgctagctgttcattattgaattcagcttttctggaatgctgatattttcttgtgctaacttgaagacaatctttgtttcagtatgctgattcatgagatctatacattcactgagagccaatatagaatatattaaccttattaatgtaatttgtacagtgtatgtaaattaacaaggctttcagtttagaaatttagctactgaagtgtattgcctctattaggttaatagaacttaatagtaagagctggatatttgtacaaatgttatctctgccttgcctttagaaatgcattagagaataaagacatttcacttattttttcattcatttttacccttagaataagtaattttaaatatatatcatgctgaacattatttttaaagaacttttccatagacatttgctttgaaaaattgtctactacaagcagtttcaaaattcttgccttgtccagcatccaaatgctgcctgtatcccttcttttgtggggagtgatggtgaaacaggctttgctttatatacaggggctgtctgatatgctaaaagaactgtgggtactgttctgtcctggctgtttttcttataagcactaatgttttcctttactcaattcttaccctcataattctgggaaataaaaagtggttgcattattggctctggcttattggcagccaaagacttaacttatttcaataaatacagtgaccacatactgaatattattaattagtaatcataataacaagttaatcttaagacatagttgacctcttaaactattatagcataaaattgtcagttttgatccaaagttacacagagaatgcttttcagagatttcccaaaggttcaagggccacatttcagatttatagcattgaaaacagaaatgaatctgtccacttggggcaggaggaccaagctatgagaagtgataaatgctcagcaaacttgccagaaactgatttataaaccagaatgctgattcattaaatgaaattggagatgaatctggtaagataaccgacatccatcatttgaacagggtactccctcttaatgaataagtccatcagactaaattgcagatcagaaggactctccacagcaggaattagtgagaaggaaaagccatataaaaggagcctttcctccaattcattttgctaaatttgttcctcattctaaagttgtggtaaggaacgttggcatctgacaatggaatgatgtcacccttgggcagtgtttgcccttcagctgacttttgtctcttcttttctcaaacacatccttgttttaagaaaataagcacttaggtcagagtttactttgtatttatgaaatttattctgaagttcctttagggtataaagtagagaatctgtcttctttaaatctgtttccttaaatccatcagctgccttttgataaactacctgtagtactgttagccttcctgctaaaatgggaaggtatcctgtgactccgaagcccagaaaccacacagctctgaggggagaagttatcacaatggaaaaacatcctgagacctggtcatccaggcctcacagctctgaggtgggacattgtcccaatgaaagggaatcctgagacatgggagcccaggaaccacattgctctgagagaaaatctcctcagtagatacccaggggagagaacgctcaactgagctgaggaaattctttctttctttctttctttctttctttctttcnnnnnnnnnnnnnnnnnnnnggcagcaaatctcataaaaacagatttattgaagagtacaggaagaggaggaaagagtttaggagtagccgcttgtgcttccaaaaggaagcagagagcagtaggggattgaccaaagcacagtgcttatataggggttcttgagggtggagctttctacagtaaagatttccagggtgaggattagtgggatttcaagtcctgagcttggtggagctcaggaattggtgggttttcctgttcaggaattggtgggttttcataagcaagaattgctgggtttctgtgggaagttcagggattggtgggttttcctattcagggattggtggcttttgttcaaacttttcacctaaaattagcataatcgatagagggtcctgttaagggtctggagatgacctttgtgacagttacagaggctggaacttagtgatagttacagaggtctgggggaggggcctggatgctgaagttccttggggcctggccactttcctgccttgagggtttacaagtttacaaagtatacaaaatttacaaagtatacaaagtttgcaaaggttgtccacctcagggggagggggggggagcctttcctgccacttgagtggaatgaacatccaagtactgtattttttcaatagaagagtaagcatatctatttctacttaatggttattacttttaattttaaagaggtgacagtttttgctattcagttgaacaactgcatacttactgataccctcaaaaaaaaaaaaaaaaaaaaaaaaaaaacaagaaacctcttcagaggaaaagaaatatcaacaaggctgtcctatatggaagctttcaatcagatcccaaagacaagtgtaaataattatggggagaattaagaaaccgtgaaggaaatcttggagaacctacaggaagaaaagatcctgacatattcaaattaaaagaaatgatatgaattctaataaaagcctttaaagagtgcatttaaaatccctcctctgaaaattctgttatgatagtaaacaaaaccctcctccatatctcatatttaattggaaaaatgactaaaattactaaccacattagcacttttattcttctctttccttttctggattagaaaagtgtcaacaattacgggaatttgttcagtagaaactagatgtcaataatggataagttcttggtctcctgacaaaaaaataaaaaacaaaaacaaaacaaaacaaaacaaaaaacaccttaatgaaaaaagtgtttttgtagctcaagggcacagtctgttatggcatggaaatcatggcagcggtggtatgaggcagctggtcacattgcatccacagtcagaaatcaaagagagggaaaggctgttgttcagttttttgttttttgttttttgttttttgtttttgtttttttttaagtccaggactacagttaatggaatggtgctgccaacatttacatttacggtggaacctctgacctcagtaaatctaatcaagatgatccctcacagggatttctggagacttgtctcctaaggtgactgtagtccctgtcaaagtggcaatattaacatcactgatggcataaaaaggacatatggaaaattaatttaattcctttatgtcttttgatattccacataaactctgggctacctggatataggaaattgtctatcatatggtttccctcagaggtgccatcttttatggtattctaattagtgaaaactcaatagctaatatttcaacaaaattaattaagtgacaatatttttatctattacaataccttaatctacttaaaatggctaacatattgtgttttcattggttgctatgtaaacaatggaaaaggactcccactatacttaatgtgtgtgtgtgtgtgtgtttgaaatccatttacattcccaagagttattctatagcttacttacctatgtttccttatgaatttcttagggagaacttaatagggagtacaacctgtgtgctatgtaattagttaaagagtggtggctgttatgattgaactgtcccagacagaacatgggtctctcatgtgtccaccatcagtgttcttttcttactattactactactactactactactactactactactactgctactactcctattactatcttctgaaaaataattttcagtttttttcttgttaatatgctacttaaggaatttaacaaaacttatataacttcttttaaataaaatgaagatttatgatgggtacaagttccatatatattttagaagattcatgtgttccatgaattcagccttgggtaccaggctaaaaagtgtggtgctagacaaaaatctcagcacaaaggatgggaagttgtcacaaagtcctttccaggcaagaagttattcacaaatagggtctgttggaatagagaaaatcaaccacactccaggacaggacacatatccaggaataattggacaaccacattaaacacattgtttttagtggattatttttccctcatttgtgtgtgtgtgtgtgttttatgaagttgggtcggtagcaaaggggagggtctaggaagaaatggtggatgtgaaataatatgataaaatatactgtataaaattcttttttaatgatttgcttattttttatttttttattgagtattttgtttatttacatttcaaatgttatcctccttcctggtttcctctctgaaacccccatgccacgccccctacctccaccagggtgctgccccacccacccacccattcttgtcccatggcgctagcacttccctattctggggcatcaagccttcataggagcaagggcctttcctcctactgatgcccatcaagtctatcctctgccacatatgcaactggagccataagtcccccgccccatgtgtactctttggttggtggtttagtccttgggagctctgggaggtctggttggttgatattgttgtttttcctatgggtttgcaaaccccttcagttccttcagtccttcccctaactactccattggggtcaccacactcggtctgatgtttgccttcaagcatccccatctgtatctgttaaggctctggcctagcctctcagagaacagctataccagggccctgtcaacaagcgcttcgcgcatatgaaatggatccccaggtggggcagtctctggcctttccttcagtctctgctccaatccttgtccttgctatgtatagtgttctgcctgcatgtacacctgtctgccagaagagagcaccagatctcattatagatggtcatatggttgctgggtattgaacttagggcctctgtaagagcagtcaatgtgcttaactttggagccatctctccagaccctgtataaaattctttaaaaataagtaaaaaaaaaataaatcatcaatatatgcatgttctgttacatgttgaaggaattataaaaataccacttttctatttttttatttcatttgatactggataaaactatttttaagctttaaaaagaggtcactaacaattggagctggggctgtctctgacttggactttgttgtctgtctttggatccatttccactagctggactactttgtctggccccagtgggagaggatgtgtttcatcctgttgctacttgatgtgcccatagtgggtacatcaatacacaagtgggggcctccccttctctgaggagaaggaaaggggagaatgggagtagggggatgtgagggtagcactgagaagagaggaaagagggtgcagaaatcaggatattaagtgaataaattaatgggaaaaaaggaactcagatagctaatcaactccacatagttcaagaaccttaacataagacctgatacagtgaactaatggaaaggaaagcagaagttccagttcaattcattgacacagaaaaatgagcctttgaacaagaccacatttatgtaggcattgagactaacagttgacaagtcgaacctcagagaactaaaacgtttctgggcagcaaatggtatattgtcattcaagataataagcagcttacatgttgagaaaaaaaatatttgccagctatacatctgtcagagggttagtatataaactatacaaagaactcaagaaactaaacatcaagaaaaagaactgaattttaataatggagttgaaactaaatagaatttctctctctctctctctctctctctctctctctctctctctctctctctctctctctctctctctccctctctctctcttacttattctcttcatatgccactcactgctttcctcttggtcaccctctcccacaatccttctccccatgccacctcccccttctcccctgagtaagtgggggttccctgggtgtactcctgccctggcacatcaagtctctatagtgctaagctcatcccctcccactgagaccagacaaagcagcccagttagacaaatatatcacatggacaggcaacagcttttgggatagccactactcaagttattcaggacccacataaaggcaaaactgcatatcttctacatatgtgcaggaaggcttaggtggagcctttatatgttctttggttggttgttcagactctgagagccccatgggtccaggttaattgactctgttggttttcttgtggaattcctatccatttcagtgaggaatttttaaaaagataaaatttaatagctgaaacatttatccactggggaaattcaaattactttgaggtttcatttcaccccagtcaaaatagctatgatcagttgttgaacatgtatgctgtttacatattgtggctattgtgtaaagaacagcaaaaaagatgggtgaataagcattcctgtagtattcatttgggtaaaccagaacatgtggtagaactagtgttagctgttgaggagcctccatactgttttccattgtggtttcaccagattacattcctaccatcagcaaaggaatgttccactttccttacatccacatcagtattggccattatttaaactgatgaatggataataaaaaatgtggtacatttgcacaatggaatattgttcactcattaaggaaatgaaattatgaaaattgaaggcaaatgaatagagctagaaataatcattctaagtgatgtaacccagatcctgcaggcaaatgtatcatcttctctaccatttttgaaaaaaaaaagaaatatattcaagatggcctaaattaaatgtagaacacattccaatgtaatccactgaatcctgcttcgttttgaagtagagtttcaaacacatgaaactctacaagtttcaaacatacagaatatattatgtgtacctcaaagaaatgaaagggtaatctgaagtcaaccagctgcttttggggtcttgtataagatgcaactcaaaattgcggtgaaagcttggccaacaaataagttactataccaaaaaccaactttcagttttctgaaattttaatcattcagaataaccgggggcaggggaggtggtagctaaattcagatatccaggaagcagtataaaatttacattcatttctatctttttgtacttagaggattataaattgtatcctagaaacagccctaaatatagtatagtttatcaagatggataatttgtgaattacataaatagacatgggaacttataaatttttacatatatattatattctgtttgatttttccatagcaacatttaacaatgtgtccaagcagttatatgtaaactaatataattcagttgcctagaccaataagaacatgtgaatcatttttaaagacttttaaaaaaatcacagctgaaaattagaaacctatctcagcaatgacatgttatatgcaaagaaaatgaattgagtacttggagcttagcacttctcagcttctcttgaaatgattttgccagaaaatggcataacattgaattcactgataagaaaagcaatgaattttcataaaacaagcatatttaaatttaaaatacatttaagatttaaagtaacaaagaaaatttcctcaaaggtttaaaacttattgagaatattaaagaaaatcacaactaatcacaaaataaactgtatctcagctactatgttcatatttaattatgtgattgtatttatatcacagttaaaatattgtgttccatcctttcaagaaaattctaatttttatatgtggaaaatggtacctttgtgcttctttcatccttcccctacttagaactgattacataacttgagagaaggctaaactttacctatacttgcttttgtttaaaagcccataccattcctctctctctctctctctctctctctctctctctctctctctctctctctctctctctccctccctccctccctccttcaccctgtctctttctctttgcctcattcttaagaatcaagatgtaagctctcaatactgctctagtactgtttgtgcctgcctgcccccatgctccccaaaagattatcatataatttagcccttggtaacagtaagcttcaaattaaatactttgttttataaattcccttggtgatagtacttggcatagcaacagacaagtacctaagagaggatttggtaccagggagtgtcatattgctgtgataggcttgacgatgctgattttctctgggactttggacataaaaaaaaatagtttaatgctataagcagggtttaatgggccattctagtagacacttggaagatagttatgctgagatcaatgtggactattgaagccagctcaagaggtttcagtgggggtagtaatattcaagtggactagacatcattcttgtgatatttgtgtgtgggggggttgttatttgttatttggtgtcttttggttttttgtttgtgttgttttgttttgttttgttttgttgcccttgtccaaagaatattcttaaggataatttgaagtttgggactaaatttgttggcacaagagacttcaagacagtctagctaaatacctaataaaaatggggaaaaaaaaagacagtttaatgttgactctaacacttggtgcagatttacagtagggaaaaaaatagatcaagtaaggcaaataaaaaaatatacagtttgagaagaaaaagagcaccaggcaatttaatgtttgagtcacttcttgtgctgaaagagatcaaggagagacctgatgtagaatgaactgaaagtggtgccctcagagcaagatccccgccagctgatgctgaaactaattcaaggaagggtccaaatttcatcccaagatgggagccaagcttgacatctttgtgtacatggttctggctttaggtcataaaggatacaagaataaaggagttgtggaatcttcctttggttgagtaaagctgctgaggccagacatgtggcagaggagtctgtgtaaaggccctgagaggctattacatgaagctgtgaaagtttacgctgattacattggagaccctgggatattgggaatgttagagaatgggatatctgccagggaaagctgcattcagaaaccagaaattcaggaaatagcccaagagaaaagtgtgctgtagtcaacaaagctggaagggtagggccatctaagttttgacatgagacatggacaaacagttttggcgatttgccctgctggattttggtcttgttttggtccagtatttcctcactgtgcctccattcttccattttagaatggtaatgtatattctgttctattgtatgttggaagtatatcatctgcttttattattattgttattattcagggtgttacaattcagagactaccttgagacaaaagagacttagactttgaacgtttgaatcatattgagacctttggtgctagaattacagttgggtgctaccagataaaattactgagaaccaaacttggtttccctggaagagtaacaagtggtctcaaagatgagctattttttccaactccaaaaatactgtttttagtagtgtacaaagaacttttgagtaaaaagacattatgctcaaatatagaaatgttatggaaaaaaaacagaaaacaaacaagaacaagaaacagttagagagaattggttcctattgtcattgttacttcatttttggaagaggattttaatatttgattcatctgtgggagttttaaaaacttaaactctaccccatagaaagcaaaatcagatctggggggatagaacacacacacacatgcttagttgaataaactccctaggtggttctaatatccagtcacagttgagaacttccagcccaagagattggagaaagagaagccctggatgggggtaacaaaggacttgagaggggaaaattctaatatcctcacttaactagttgatcctggtaagattagtaagacaacaacatacaaactaacaaaacaagcctcagttctttaccaatgaatgtgaaagggttatactgatagttttcaaaaattcacatttcctatatatagagtttggaactgaccaaagctagctactaaatctgataggatacttcttattctaatcttaatctaaactaatacatcttggaccatgaataaagctactttagctagaccacatattaaatactccaagttttgagagatggaaatgtgaaaagtcaggtgtaaagttaatatgagggtggatgatgtctaaagctcctcctagggtggatgatatctaaagctccttctatctcttgatgtcagtaaatatactatttttccctcataaaattcatagactgcttattacatgcttggaacattctgtgtgtaaaggctattctcatttattctaattctgaaaatgtgctaattccttggtgtataagaagaaaagcaacagttggccataaaatgtgatggatgttttagtggctatattcagctgtaagcaataaatgctgagctcagcagaaagtactatcggcaaaaatgcaagtgatttactagctatctaaagcactagagatttgtaatgcatgaaacccgcaggcccatcacttcccttcagtaatgggaaacaatattttggtgaaaaatgatacatttaatttcatgttgtgttgtaaagcaaaaagctagctgaaacacaggtgtgtgtgtgtatatgtgtgtgtgtgtgtgtgtgtgtgtgtgtttattctttgtacagggtctttagatcttattggaaacacaagtgatctcttaaaatgcaggaacagtagagtatgttagaaaaatatctattagtagacatttattattgattgtgttcatccatggttcatgggatcaaatgtgaaactaacactgttacagaaccattatattctggtagcctctcctgagaactgattctaataacatagcactctttaaggcagatatgcatccaggtgattgtcatggtttcatacggatactgaaaacagtcttggcttccaaagaaaaagaaaaaaagatgtaaggaaaaatggtaagagggtataatattaccccccaaattgatctagaatgtactcataaaagaccatccactcaaatatcacctctgtaaatgattaatagtttgaacaccagaaacgttcagtgtctcattatataatcctgaaaaacactgacccttttggcagtttcaatatgaaagataaatacaacctctttcggagctctttgaaaatagagtctgtatttcagaataaatgtcgaacaataataacgatgatggaatagctgatacaatgcaaattttaaatgaaggagagtaactttctaattactggctacagtttattctttgtaagtgtaattagaaagagaccatgttcctttaattagaaagttaattagattgtgacctcttttcctgccttattgtctttgactgcaggctgggagtaaattacaaatcccaagacctatgtgtctatagcccctccaaagccagatttgttaaaaacaaataggaccataagcaatagtactaggacttaaaattgagttggggacttcctagaatagcaaatagttttattaggaaaagtgtttatgcagatgaatgaaggagatactttttgggatcaaacctaggcagggaactcactaaattatattcttcataatgttgatctgtttcccagtggctcttatattctagtatgtatgaaatatttgttagaacaaatatttctctgcctcatatataaaattcttatttctgtgagttttggagttactggaaaaaggtaaattttgttgttgttgttgttgttgctgtgtgatagctaagattgttgatgaactttgggactcttcaagtaaatacatacatttgactatcccaattgctggaatgtctataatttactttgaactatttcgttattaacaacaaatgacagactatgtctgttgctttgtttatgctatattgcagagatgaagttgttgtttaataatttctagacgtatatcctcataatcaccttcatgtaatattagagctgtatcagaggttttactatttcacagtgatttttaaatgagttgttagtagggttaggaatttttttttaaattttagcataagttagaaaaatgttaagaatgagtttctacagttgtaattattcatgtctccacacaaaaatgtttcagagatactctccatttctgtagtagaagagtatacaaatcaagcgaggcatcactctttcatgtaagaaatggtactattaactttatcattcattagagaagtttcttaatagatttactcctactagcctaattagttcaatcatttctttaacatcatatttgcctcaggtaagaattccataaaaaatgctattggacatctttttaaaggtttgtaatttaatagtctggacgttttgtgtgggcttgttaataaacatctagagaaatttgttctgagattttcctacattataatctagaagcaaagttcctcaagttagggactacccatctaccacctctaactagtagcatttttctaaaagaaaaaaaaaagtatatatagtatttgtgcagaaagattgttccatgctccaattcacgttgagcttatgtttgtttgtgaagtagtttatgcaaatagagcccttcaaaaacacttgatgaaatgttttgatattactttcagcctcatagaagaaagattgtagatgtcagagggaagcaaacagcattagtcaatgaatctgtagcatctcaattgtgctatgtgaaatggcatggggagcaaaacagacactcagaatcacagagaaggaaaaaaagtgaagaaacagtgattctatgcttacattctcaataagtttccaagggaaataataactaaagagaaataatcaattgccttacttgatgatatgaattatattttgtctagagagtaaatgctctagagctggcacaaaacactgactacagcacatttttatactaggaactgtgaagaaatcctgttgctgtgttctcatttagtgtaatttaacgtaagatgttgctaattacatgctgttaatactgagtgaaataaagaactctaattctcacaatgttggtgacaaatattttcaataaatgcctgtatttgtactaggggtgttgatgttcctatgctgctctagttacaatttcacttactaaatgtgcttaaaaaatatgggaaaataatttgatggcataatcataagagagtactctgcattggaggtagtttgggaatcagttgttaattggctctaccctttactgtgtactaagagcttgcaaaattagctaatttttagaatatcaacttgattctccaaaaatatactaataaaacattatcttataaatgactcacataaaaaatcatttgatatagctatccatatgttgtctgtcatgccaagatgggagctattagtgaatgaactcattacctgtatttatgactctcttatctataaaacagacaaacaaaagtcatgtgatacatggacaggggagatgtctcagtgagtgagaccactttctttgcaagggtgggaatcagagttaaaatctgtagcacccatatgaaattaggcaagtctatgcattattataacccatgtatcggggaatataaaaagaacagattccagaaacttggttactcgtcattccaggcaaaataataagtttatattttaaaaacgaccctatctcaacgaaataatgtagagagcaatacaggaagacacccagtgtcccctgaacttcacatgctcatctatgcaaatgtaccacccacatttattctacatataacacagatgaaaattaattaattaacttgcaatataatacaagggatgataaggtaccataataaaaacataaattaggataaaaaagtgagagcaataaaaatcctttattagtgacgtacatcaaagcatagtcctatctcttttttatcattttaagttcaatgagataatatccatgcctttacagtgaacaattgagaaaatttgcactctccagtgtggtgatacagccctaggtaatgcatatgtaaaatacattgtaaatatttgacacaatatagatgttcagtaaatgatatattctattctattgtaattaccaacactgttggactgatatcttttcacaagcacctaactcatgtgcatatttgggaaacaaactcaataaaagaatatttagctaataaaagtgaatcaaaaaggagctaccagttataaagtgggtaagtcttctgtataatgctgcaacagaagtctgagctcttactatttctttcatgagataattactatgattattgcagtagcttatgctccctagattattgatagagaaaatatgtgtgataatagttagtaaaaataatatcagctgccagcattaactagtgactatttatgtatcacactgtactaattgctttaaattcactactgcttttcattctcgcactaattctctaataaagacattaagacattgtttaaagtgatgtatccaggaccacttagacacttattattagacctaggatttgaccttagagcagtgtgaaaacaataattatgtcattattcattaaatttgcaataaatatttgcaaaaggaaaaattgtatcatgacaacttttatatacttcatttaacatatggaattaataactaggctattgtcccagactctgaagtcctaatgtgcatgtagctatcttattttatgctatgatcagaaactcattcatacaattctaattcatcatgaaagtatgtttaaaaaaatggaaatatgggggctggaaagatttctcagcagttaagagcactggctgctcctccagaggtcctgagttcaattcccaacaaccacatggtggctcacagccatctgtaatgggattcaatgccctcttctggtgtgtctgaagaaagcaacagtgtactcacatacataaaataagtaaattaatcttgcaaaataatcatggagattttataacttggctgtgtttgaaaactgaatgtccagctactacagcttatttaaattttgaactttatacactataatgtcctctgttggtacaagtaatagaaattatttgccatgaaaacaaaaaccagataattaggttgtaaatgtattataaattataggtccttttttcttcattagagatgttcatcaaagtattgtcctatcacttttcaatgtgcaaatgctctgcctctgcatctgaactatgtatgatactacatgatagatgccattttaattaatttttccttgagtcatttgtatcataaaaagacagtacaaattttaaggattttgtaataattttatctgacaagatttctcaagacaccttgatttttttttaaaagtagaattggtcatattcagttttatttctatagataattttgatttcttttattggtgcttcttatcttttgctatattcagtggatatatttgcagatgacttagaattgattcttatgaaggactggaagagacttatactagtgaatctcaaccataattctctctagccagatccctgctctaatgctgaatgcaatgtgtagcatgaaactgacacttatttagtattagtcatttggaacactcacagaattaatgaaatatatcaaacaactagcaagtaggaaacagaaagttgactttatgcttcctcttgtttgtttagagtttaattcaagaataaagaattagttggatataaatactagatagaaatacaatagtgaatatatcataatttatatgttctacacacatttatcttattacatttttacttggtgtatatatgtattcgagcacgtacacatcacaacatgcatgaagaggtcagaagacaacttactctactggtttggtaagaacactatccaaaggcagcaaaataacagttaccagaagctctgtcaattggggttggacaggtagtgttaaaacaagatttgtaagccctatggctcagcaaaattaaaattgtgattttggattctgacttaaaataaagctgttttaaagagaaattagtgcagtgaatgctccgctttccaaaagccactctattataaattttcattgactataagaaagatataacattaactgtcattcaatgtataaatagggttctctgtaaattactgtgaatcatttgacgtttattcatttagatgaactggtagtgcatgtttttaatcccagaacttggaaggcagaggcaggtggatcttttagtttaaggccagctggcctacagtgagctatgggatactcagagcagcacagagaaaccctgtctaaaaaaaaaagaaaagaaaagaaaaaaagaaaagaaaagttagaacatgttgtggtgtgaaagaggttgaatcagcacagtaataaactgatctcaaaggggattcatgagattctttgagtaaagcaaagataacaagtaggaatcaaaacaccatgagtagggttacagtatattagcattgttatttaggcagattctttgcagcaatatgagaaaaacttttttgagattgactggtgaattaaataaggagtaactaacaagaagacagaaacttagagggtctacattaacaaaacagctagtcatgatcagtatttgaaaattactagtgtaagatattagacatgactaatggatatggctaccattgtcaagacacagatgaaagaataagaaggtgtgagacaaagaatagtaagatagtttttattcactttacatccagatcactgacctcattctggtccacctccaacactctctccctgtaaccccttctcctcctctgagagggctggagggccccgtgggtatccatatgctaggttcctatctgcaagcataacagagtatcatttatnnnnnnnnnnnnnnnnnnnnaacagagtatcattttatagtgtcaggggattgatgctttaccaagggatgtgtcttaagttggggttgattattgcttgaccagtttacctgtctgataagttaatgggttatttattttgataaacaatacaattattcagttgaaataaaattatttcatatttgtgtttgctcaatgtcatcagaacagaacattccttaggaagactgtcacgttagatagctactgtaatttaaataatgaggccactattgtcagcacctagtatgtctccactgtaagttatcctttccttttctagctagttgtcagtcatattgaactagcagtttctcttttatctcaagttactttcttaatgttggctccaatgttcctaaacagaaattcatgacaaatgttcatcttggctggccattattgttaaaattagaattgtatgtctaccccatacggagtaacattacactaattcaaatttaacataaaagatgaaaatttcaataataataataataaaatgaagaataaaaataagaaatatgagcagcctcaattaattctgctgccttgatttcctctctccccccattaagagagataacaacagagacctttactcaaaagccccattatcacaaatgcttctatttatgatatagtagcactaaaataaatataagcaacagcaaacggtgggaccaggaaggccaaagaagcacaaatcatttgaataaaccgtagcaactattctatgatattggctgacacaattaattcgctcaagaaactcttcagaaaagtttctcttgttcatttggttgtaaataacaagtgtgtgagacaactacctttcattaaaatgaaatgctttggataattaacctataaaagaaagggtttatttagctccaaatagcaatagcagtggtgaggataacatggcagagtaaatggctgatctcagggccaagaaacaaaagaagaaagggaagcaccaagagttccacagttctcaacaaggacaatcccaaggacttaaagacctcctgtgaatccacatcctaatggtcccatcacttctcacaacttgtaaatatagatgtcacacttattttcttagagaaaatgatgggatgaacctacccaagctgtgtgaatatatggcttaggctgatcccagagctgttccttctctgttctagctatccctggaagcttttaacctctgtacaatctactcttccaagaagactgattcagtccagcttctctcttcttcccactgaagtgttctgcttggcatgtatacattcctgtcagatcatatgtttggatgtgattctttgccagagcataccctacaataatggttgtcaaccttcctaatgctgcaaccctttaaaacagttcctcacgttgtagtgaccccaatcgtattgctacctaataatgtaattttgctcctgttagaaattgtagtggaaatatttttagagacaggaggttgtcaagcagtcacaacccagaggtagagaacccctgccctacagttttgcctatagctagatttatggaggcattttctcaaatgaggctccctttcctccagtaactccagcttgtatcaagttaacagaaaactaggcagcacactcacattcctatacacacacatacatatactcacatacactcacactcacatacatacacacatacacatatactcacatatactcatatgcatacacacaatcattcaaattttggccattaaatccatgtaatgtactactggtactatgtgttagttccttttgtctttatttgctttccatttataataaaatcaattccaaaatactcagaaaagtagtggacttgaaaacatgagcagattcacttataaaaatgcatagtgaaagaaactgtacaagttttaagacaagtgcaaagacaactttgcactgagtatatacaatatggccttatttgttcgtgatatccagagctagtcagtccttttcacaaggttatctgaggacatcctgcatcattaccatctgggtgcttcatattgaaatacatttcataacttgctacagattcagtgaaccaaagtttatgagaatgacaccagaaaaacgaatatgtttgagcattttgatagccactaaaattagagaacacttataccttacagccattgaaaatatagtttatataactctagaattctgtagaggcaatcaccatgagtcacctaataaaccctatatttatttacatgtttggtccagaatctatatatttcagttattcaatttgatttaatcatttatccctggagaaaagtaaggctgagcatttaagcaaatatgagctaatcagatactatgaatatcagtattacctgacatgtcaggaagaaacaataatgaagaaggggaagaaagggaatagattgtagtttaatagagttcttgtcttgaatgcacaaggccttgggttctacaaccagagagagagagagagagagagagagagagagagagagagagagaagtttcatatgtattagtttatctttgttgttttctgtcacttctatctaaaaggaactcaagctttaacggagatctgttgacaaactctaaggtatcataaggtcatgtctccatgtcatatacagaaacaattaattcatttctctaaaagtgttgtctcccatacagttcagaaaatggatacacattgactttattaaacagcagtagaagtctagcatttgtctatctcagggtgtggctcctgttaaatattcccacaagtgcagtcatataaataagacactgcacctaggaaatatacctgtaataagaaatctccaaggaagaaagatggggcagttgtatcctaaaatccttatttttactttcaggaaggagaaaatagtaggagagagaagaattaagagtccacgaaaatggcattgaacgagtgcagataggataaaaggagactaataaaagaaatagagcgcagaaaagctaagttgtctggcaattcactagaactgttatctgtgttttgactctcaatttctgagtcagaatctaccaataacagctactaaatagatcagactaaatatcccagagcacccctttttaacagtgtaaagtgctagagagagtgacccagttataaaaagcaaggtcctagatctgctatccagtgttttgcggggtcaggggtgggtattgttgttgctgttgatttttgtttgtttgtttgtttgtttgtttgtttgttttttagaataacaggacccctcaaggattttggcacaggaagtaaatacttaaccagaaaaaaaaaaaaaaaaaaaaaaaacaaagcttatatcagtgtaaataagcttgggaaaaacccttatactgggttactttcctgaaaaaaaaaaaagtttaattgttcattagaaatcccagtccacagattaccactgtaaatcattgcacacccagctcctttgcaaagtgcgaagcaatctgctccgtacacctcagatgcctagccaaatcaacacagagggagacttttaatcatttcaacaagcagggcacactagtgctattctcaaacaacgctggaaggttcctaacacctgtgctcaccctagactgtacttcctgtgactttgtagtggcaggggttttgatttgctttttagttggggttatcacagcccaaaagcaaaaatagttctgtcaagaaataagaatcatgcatgtattttactcttcaaatccatcagcttaactgggactgtgtcttagttgaaggttctgcatatatctacctttcatttttaatttccctaaaatgaatggagattgcctcctgtacttatttttttaatatctcactcaaaggtccttgctctgcccctaacatcatgaaatcacttggtaagcagcatccctgagacaaaagaatctgaccatgtttatatgcaggaaagaggataaattaggaacaaattagcatcaatatgaactgcttataaaagggtcatactgcaaacacaacttataaatactccagcagtgagacttcttaatcactacattttctaaaacattctactggaaaaagtaattaacaacttctcatgttaacttaaaaagggtataatcactgaaaagatattatatgcagataaatagtatttgcatgttaacacatattttttatctcaaggatctgattcattaactcataaaatgaggaagcgataagctaactggcaagttcttacagtgataaatgtctaatgtgaacctgttagcgctaattttcaatttatctagatggcaattcaaagtatctttctataccaggctaagaccatacctatcacagcagaagtccaacacttgatcaatgaattgtatcacaatggcagtttctaggtactagacagcttaatctattttgatcactagtgtatctatagtgcctaaacaatgtttgtcatgctgtatgctattaaaaagtgctttcaaaattaacaaatagatcttatttgttttggtgacaggtttactattaattaataacattggccacatcaacttacaggcatgaatatcctttttgggatagaactaaccataagatatgttacttaattaacattaatagggtgtgttgaggagggtctcagaatatcccttttcttccaatggatttatgtcctcataaatttcaactgtctagaagattggaacaaacatcttttgtcatatatattgcagctttcaagctaggctgccttccacatacaactcagggaatctatctttctttctttctttctttctttctttctttctttctttctttctttctttcgtttgttcgttcgttcgttctttctttctttctttctttcattctttctttctttttctctctttcctcctcctcctcctcctcctcctccttcttcttctttttgtcctgattgttgatttaaaaaaaatggatttatttcagtaagggaagtggtgtgccgcaggatgtgcggaggtcaaaggacaatttgtgggatttcattctttcttctaccatgtatgtagtttctgggaattcaactcaggcagtcaggcccagaagcaggtattttaccagttgagctcttttccacggtgtctatatacatttaagaggatcatatttattcttataaattcatttctccagttggcatgaaagaaaatcttgggcattaatgttaacaacaagaaaaacaacaacaaaaaaggattcaactttccaaattctctgactctgtccagtttttcttttatgtgcataagtgttgttcctgcatgcatatctgcttagcacattccttcagtcatagggtcttctttttattttattggttattttatttatttacatttcaaatgttatcccccttcccagtgaaacctcctatcccctcctcagtgacccagcacagttgaatgtgagaggcaacacattgcctcattttgaagtgttacctacatggttccattgaccctcaacatgtttgactattgtcaatactcttggctactctccagaacttgataataagaccctatgactataagggaactctcccgcccgcccaccccttcctgcctcagtgccctcgcattgatggtacaaaaaatatggatctgtttcctagtccaatttgttaaactattactggggaataattgagatcattgatactaaaagttattttaaaatatttattaatttcagttattttattgttgtggtggtattttcttagaccttttggttaactgttacaggattatatacacccttgtgttctcttgaatatgtttagtctcttcttgagtatgtgtaatcttctcttcagacaaaaacagtctttctagtatcctctgggcttataataagtgccttaaatctgtttgtgtcatgggtagtttttctttatccttcggttaaaactgatagttttgctaaatatagtagcttgggcaggcacttttgatctttttgaaatcttagaacatcagtccagacccgtcaggctttgaacgtttccatttaaatgtcaggatgaaaacacttacttttaattctagtacttggggacacagagtcaaacagatctctatgagttcaaggccagcttgctgtacatagaaaggtttagaccagccaaggtgatatagtgggtgggaccatattttaaaagccaaaccaaacaacacaaaaaagttaaatgttattctgctaggtatgcttttatatgtaatttaatatttcttgaagctttcaatatatatttcctttgttatatatacttagtattttggctagtatgtgacatggttagtttcttttctggaactattgtactctgtgtacctcttgcaccttaataggaatcttttctcttagattttcttttagtgttttctgattagccatccagatttctaaggatatgaatgttagacatagccatgagataagatatccatgcttttgtatagtataactcttcctatttattagctatataatatggaaattttcttctcttttctttggatgaaagtcaactttttgtgtttagaaagttctataaagtcatatctaagaagtggaattaagatgtatccattacaaaagaagtttgtttgtttgtttgtttgtttgtttgtttgtttagttggttggttggttggtcttagcattctatcagtatagtttaatgtttaaaatagcactctatatctcgtgaatagctaaatatacatttaagtagaccacagcaactgcagttctgtctatttaatagaaattgatgaacacttatgttcatacaaaaatatgtacatctatgtttctagtaatataacttgttctttcaaaaatattaaaacttccttaaaaagccttcattgtatgagtgaagaaataaatggtatttagtaaagcaatataatataatatttttaaaaagaataattaattgacatatacaacaaaatggtcagatccaaaggcattttgttgagtgaatgattaaatagtgacatattctacaacttctggaaaaagcaaaactagtagtagaaactggggctggagagaaggctccacagttaagagcacatactctattggagaggacctgggttcaggtcacaacacccacatggtagtttgtaactatacttaaatctagttccaggggacccgaaactttccttcaatctacacaggaacagaaatgcacatggttcatgtacatatatgaaggcaaaataatcatatctataaaatgaagataaatcttaataaaaaaaccctacagcagtaaagaactaagtaataattttccataattatacataaggggaaatgatgcattaaagaaagatttgtagtataactatcttataagacaatgatggtttttacatgaatttatgcatgagtcaccatacaaagagtcataaagtaaaacaagtattaatattttgtatggaatttaaaaacttaaaaatattaaagtagtaaaactgctacattttgttcactatacatttacaacataaagaggtacctgaaagtgtgttaatcaaaaggttatggtctatagaaagacttcagaataagaatttatttcatctgctatttgagaaagaagccatttccccttttaaaatattacacattttannnnnnnnnnnnnnnnnnnnaattcattttcttatgctttaaaggttaaagtatgacaccatatcatgaatgaacatatatgtgcatgtaatagacaatgaacacatgaacagcattgtagctataactttatgttctctactttacttgcataattaccctttcttatgcaagaatttcaacaaaagaaaattagtcaataggccccagggagtttagaggtcaggtagggtgggggttgggggcatccacatggagatggggtggggtgggaaggaggtatgggatgtggagcagacagaggacatttgggggggtaatggaatatggagtgtgaaaaataaattaaaaataaaattttattatatatatatatatatatatatatatataatttatttattcactttatataatttatttattcactttacatcccaatatcagccacccctatcctccaggtatttcctcatgctagtcctttcctcattccaccttccccttctcaaaagttcccctctgggtgtcaccttctactaatcaagttagggattaggttttttctctcccactgaggccagacaaggcaacatagtccatttaggggcataggatctacaggcatgcaggcaggcaacaggctcagggacagcctctgcttcagttgttgggggacctgcaggaagaccaagatactcctccgttacatatgtgcaggggacccatgcttgctctttggttggtgattcagtctctgggcacccccaggagtccaggttggttgactatgttggtcttcctgtggagttcctgtcctctttgggtccctcaatctttctcccatctcttcagtaagactctccatgctccatctaatgcttggttgggtgtgggtcaatgcatctcttttcattgactgatgggtggagcctctcagaggacagttatgctaggttcctgtctgcaagcatagcagagtatcatcaatagtgtcagggattgattcttgccatgggatgggtatcaattttgggtagtcattggctggttattcactcagcctctgctccatctttgtccttatatatcttataggtaggatatatcttgggtcaaagttgctgtccttattatgccactcagagtcctgcctacctgcaggaagtagccacttcaagatccgctggatcagctagagttgctagagttgcctctataggctttctggacctctccccatcccaggtctctggcatgtcctaaagattgccctccctagctgatttccattttctgtaccctgctattcctacatatgatctccttcctgcccaactcctctccccatccctgatgccaccaaattctctccttccatcaacctctaacatctgttttgattcctcttctaagaaagattcaaccatcctccctttggccacccttgttatttgacttctttgggcttgttgattatactgtagttatgctgtactttatggctcatatctacttataaatgaatacataaccatgcattgccaagtcctgcatgccatgccaaagggacagtatgacactgttcctgcccctggagcacagtcagcagggtgtggccctccatgactgttgaccattgctagggataaggcttgtttgtttaccttatgtccctcatttaggattaatgttctgctagccaaggttaatgactccatgataatcagaaacagcatgagtcagggaggcaaggatatgtgtaatgattttagaaaaatggtaaatgctgtgacctacaagacaacccttaaggctataggaaagaactctaaaaacatgagttcaaaaatataaaaggagaatatctcaactatgcaaaatataaagatgcaatgtgagttatatgaaggcttcacggatataaaaaacaaaaatcaaaattagttatacctacaatatgagtcagcttatcagaaagatattagggaaggagacaaaaagatttggtgtttacagggcaagatcccacccactaagtttattgtctgtgtttacaaagacagacagacctctgaatttatttgcaatgttagggaggtatggggactttcaggatagcatttgaaatgtaagtgaagaaaatatctaataaaaatttgaaaaatagataaataatatttaaaaatgcacttgctatcttttcctaagaatcaaaaggctaaggtaataaaaggctaatttgtgggataatcagaagggagcctggagtaaatgaatgaattgatatgtaaagaaaagactgagctctgctctgcaagagagagttaccacccagagggaaccgcttggagagtgaacacagctctttaagaattttttttttctaacatgatttatgatttttgttgcaaaattcaagaattgtttctagccgcttttctgactttggtcagaaaatccaagaatatttttttttctagcagcttttctaactttggtaggaaaatccatgagctatccagagaacttttagaattttttctggcatgagatagttgtctttagcagagagccaagaacagtctcaagcagaaacctatctagaacagattacagaaccaagagctatttacagagctgtctggagagccattgagagcagaagacagtgcttttatcatcattgactttgagtcttttctcatgccacttctgaacatccctcagttcctcaaaacgcccctaccaagctgaagctaatctttggcaatgcaagtcctgttggatatgggttaccacctgcaggatgatattttctagttccatccatttgcttatgaagttcatgttgcccttgttttaaatggctgagtagtatcccattgtgtaaatgaaccacattttctttttttttaattaggtattttcctcatttacatttccaatgctatcccaaaagtctcccatacccacccccacaattccctttcactactgatgtttctcaaggcccaccaatagtttcttctagacctgtaaccagactcaaagcaaaacaggctcctagaggggaggtagaaagtgtagtccatgaggaaattcgctatactactaaggagcttaatgagtttgctaattcattcaagcagaaacctggtgaatatgtgtgggaatggattttaagggtgtgggataagggtggaaggaacataaaactagagcaggctgagtttattgacatgggtcctctgagtagagattctaggtttaatacggaagctcgcatagttaaaaaaaggtgtcaaaagtttgtttgaatggttggctgaggtgtttatcaaaagatggcctactggaaatgacttggagatgcctgatattccgtgtcttagtgttgatgaagggattttaagacttagggaaattggaatgctagagtggatatattgtgtatatcccctacccacccactccccctttttggccctggcgttcccctgtactggggcatataaagtttgcaagtccaatgggcctctctttgcagtgatggccgactaggccatcttttgatacatatgcagctagagacaagagctccggggtactggttagttcatattgttgttccacctatagggttacaggtccctttagctccttgggtactttctctagctcctccattgggggctgtgtgacccatccaatagctgactgtgatcatccacttctgtgtttgctaggccccggcacagtctcacaagagacaactatatctgggtcctttcagcaaaatcttgctagtgtatgcaatggtgtcagcgtttggaagctgattatgggatggatccctggatatggcaatcactagatggtccatcatttcgtcacagctccaaattttgtctctgcaaatcaaaacaaccctgagattccacttcactccagtcagaatggctaagatcaaaaattcaggttacagcagatgctggcgaggatgtggagaaagaggaacactcctccattgttggtgggattgcaagcttgtacaaccactctggaaatcagtctggcggttcctcagaaaattggacatagtactaccggaggatccagcaatacctctcctgggcatatatccagaagatgtcccaaccagtaagaaggacacatgctccactatgttcatagcagccttatttataatagccagaagctggaaagaacccagatgcccctcaacagaggaatggatacaaaaaatgtgatacatttacacaatggggtactactcagctattaaaaagaatgaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtagggtaacccaatcacaaaggaactcacacaatatgtactcactgataagtggatattagctcagaaacttaggatacccaagatataagatacaatttgctaaacgcatgaaactcaagaagaatgaagaccagagtgtggacactttgccccttcttagaaattggaacaaaacacccatggaaggagttacagagacaaaatttgaaccacattttctttattcgtttctcagttaaggaacatctaggttgttttacagtttctggctattatgaataaagctagtatgaatgtagttaagcaagtgtctttgtgagatggtagagcatcatttgggtatatgcacaagagtggtatagctgggtcttaaggaagaattatttccaattttcttttttttttttaattaggtatttattcagttacatttccaaattgatttccagagttattgtaaaagtttgcactcattccgacaattgaagagagttccatacatagccagcatgtatgcgtgctcctttgagattttgatcttagccattttgatggatgtaatgtgggatctcagaggtgttttgatttgcattttcctgaagactaaggaaattgaaaaatattttaggtgcttcttggccacttgagattcctctctgttgaaaactctctgattagctctgtactccattttttaattgagttatttggattgtcaatgtctaacttcttaagctctttatatattttggatattatccctctttcagatgtagggttagtaaagatcttttcccaacatgtaggctgtcattttgttctaatgacagtgttctttgacttacagaagttttaagtttcatgaggtcctatttattaattcttgacttaatgcttgagccatttgtgttctgttctagaagttgtctcctgtacggagaagtcaaaagctattctctactttctgttcatgtatctggttttaaattgagttctttgatccagttggacttaagttttatgcacagtaatatatatcagtctatttgaattcttctaactgcagacatttagtgagactggcaccatttgttgaagatgctctcccttttccattatatagttttggcttatttgtcaaaagtcaagtatctgtaggtatttgggtttatttttggatctttgattcaattttgttggtcagtctgcatgcagtttttaatttctctgtagtatactatgaactcagggatagtgatattaccagaagttcatttattgttcaggattcttttagctcttctaggttttttgtttttccatatgaagctgagaattgttctttcaaagtctgtaaagaattgtgttaggattttgatggggattgtgtattgaatctatagattgcttttggtaagatggccattttcactatgttaatcttaccaatccatgaacatgggagatctttgcatcttctgatatcattcttcagggacccaaaattcttgtcatacaaatattttaattgcttggttagagttataccaaagtattttatgttatttgtggctattgtgaagggtactatctccctaacatttttctcagctcatgtatcaattgcatagaggagggctgctgatttctttaattttttatccagccactttgctgaaggtgtttataagctgtaggagttctctggtagaatttcgagggtcacttatgtatactatcatatcatctgtgaatagcgatacttcgacttctctcttttcaatttttatcaccttgatcccctttagttatcttactgctctagctagaacttcaagtaccatactgaatagatagggagagagtggactgccttatcttgtccctgatttgagtggaattgctttaattttctctccatttagcttgatgttagctattggcttgctatactcttccttttttgtgtttaggtgtgcaccttgtatcctttgtctctccaaaacttttaacatgaaggggtgttgcattttatcaaacattttttggcatctaatgagatgatcgtgtggttattttatattgttctttttatatgctggattacattgatgtattttcatatattaaatcacctgtgcatctctaagatgaagcctatttgactgtggtagatgatatctttaatgtattcttggtttctgtttgagagtattttattgattatttttgcatcaatgttcataaggaaaattgttctgaaattctttctttgttgtatggtttatttatcagggcaactgtggatttatagaatgagtttggcaatgttcctttgacgagtattggtattagctctttaaaaatctggtagggttctgtactaaaactctctagcctagggttgcttgtttgtttgttagggtttttttcttgggtttgtttgcttttagtttccttttaatgactgcctctaattctttgggtcttatagaccaattcagataatttacctggtcttgatttagatttataaagtgttatatgtctttaaaataattaattttattttagagaacacccttttgaagtaagacctaatgattctttgaatttcctcagtattccatgttatgtattctttttcatttctgattttgttaatttgggtactgtctctgtttcttttaggtagtcaggctaagggtttgtctatcttgttgattttctcaaagaaccagctcttggttccattgattctttgtattcttctctttgtttctaattgattgatatcagtcctatgtttgattatttcctgccatctactccacctagatacatttgtttcttcctttttgttctagatccttcaggtagtatttatgttagtataagaactctctaatttctttatgaggccacttagtgctacaaacttttctcaacactattttcacagtgggaaagtatttttaaatttggttgtgtcatggaatactttggtttctccatctatgacaattgaaaagttttgctggtatagcagtctgagctgacatctgagaactcttagagactacaagatgtctgcccaggcctctctatcctttagagtctcagatgagaaattggttgcaactctcataagtctgcctttatatgttacctggcctttttccactgcatcttataaaattctatctttgttttgtatatttagtgttttgaattattatgtgatgggaagatttccttttcttgttcaatctgtttggtgttctgtaagcttcttggacatttataggcatctcttccttcggattagggaaattttcttttatgattttgttgaagatattttctgggcctttgtgctagggatcttctcctatttctatccctattattcttaggtttgatcttttcataatgtcccaaatttcctggatgtgttgtatcatcactgttataggttttgcacatccatgtgtggggtcctgcaaagcaaaaaacatgttatatcactattcaatatgcaaagtataagagagcacctaaactggaataaaaggtaaacattaagtatattgactagttcaccactgggcaacttgagacacagcctggcaggacagaagaacaagctcagagattgactggagctcaggcgaccatgtgcagctcacttctgcaggctatgtcctgggataacccaattgggaagggattggtggaatagggctccaagctggttagtcttggggccctgaacgcttccaagggaaagtaggacactcttagggtcatgcaaggcttctccaaacttaagagcaagcccagaggtagacaatagagctcaggggactacgagcaactcacctctgcaggctgtgtctcagacagacaaactgggatagtgggcagatctgactaggatgggattggtgggcagggttacaagttgattagttttggggctcctaacattggcagaacttttccatagggaaacaggatgctctcggagtcccgcaaggatcctctgtagtgaggaatgagcccagagctagactgtggggctcaaggaatggtatgcaactcatctctacagtctaggaagctagtcaatatatttaatgtttatcttttatgccagttaagatgtactttgtatatggtatagtaatataacatgttttggattttttgtttcattgagcaatcttctcaaaatatgtttttaattacaatagagttataaatgattatgaatcagggactatagaagaataatacataatatgcatgtgagagtaaaccagactcataaaattattcatgtggctgacgagatggttcagtggttacaagtgcatagaagactagaggttgattcccaacacctatgtcagttgtcacacaaccatctgtaactcttaactccagaggaacaaaatccttctctggcttaagctggaaactgtacttgggtaatgcacacataagcagatgcacacatatatacagttaacaaactaaaaaatagcaataatttttttaaaaaaagaaaaattatgcaagtggatactgagaggttaataaaccatgttcctttaaagacaatgtgtgttacatctatatgtgtgtgtgtttcatgcttccatttaagatcaaaagggtaatactagctaaaataaaaacattttcctttcataataaaataggtcaagttactgattttatagaagaattaaagtcttatactactattgttttctcaaatactttttaatggagaattttatatttgtttatgttttgttaaaaattacttaaaagaaaaataaaataaacagaacagcaaatgtttttactgttgttaaaatgaattttaaagagacattaccttagcctttcttttctcctttgaggcctacatttattacagatggtgttttctatactgaagtgtactgttgaaactataggactaacagttcactgtgaacaacaatcataaggaggagaattgtggagaggtggttgtaaacatcaatgggtgactctaggaaaaaacaaacactaattagacaaactgttctgtatagtgtgactaccatttccctcttacacattgcagagcatacatgtcttgtagaaaaccgaatgtgctcaacttgtcatattaaattccttttccttataagccaatgtggtggcacatgcctttagttccagaacttggggacactggaggccagccaggttgacggaccaagttaaaggacagcatgggctatgcagagaaatgctatctcaagaaaagcaacaataacaaaaattcccatttcttgtatccctaccataattaataatgtgattatatttcttgtttgatgatgttcattataattgttagttatggggaaacccattgactaccaaaagccagccttgtattcctatcctggtcattggcatcactctaactacagagctgtcagcagtttcaggctaaatggtgatttcaggggtttgcaattcaatcatgaaagttagctgcaggcacaaacttttagccagaaccaacaggaaattttgattatatttcttacaggaagagaaaagtacatgtgaccattataagagaaaacaaaatccttgtagaggacttgctgtggatcctttcctgttgcatgacaacagcaatttaagattcctttcctgccctgccacctctgctttccactgcacccactgaggaatcctaccgacttccagtgttagatgactttacaatgcatttctttaaggctactcttctgttttagcttgaaaccaagttacattttgaatcccatttgtcaacggaaaaaggaaatgccagccatttactatagccttccatgcattcaaaattagaatcattcttctgccataatgcagcaacacagggtatgacctgcatggggcttcatgttttatgattgagcagtaagatctggcttctgaatgtaaagacgtttctttgatgtgaggttgaattaaggaagcttaattaacattttctaattaaatacagcatggtgaactcaatcactttgtactgtgctttgatgagatcactctgcctttatttaaataaacaagatggcttgcagggttgagagctagagacacaaccatgtctttgctttctcagttgccagctttgtccttcagaaatatttttagctacgcttacaattgcaagaattttgtagaaatgtgttttttcaaaaatactcaaggcagccaggcacacatctgcaatctcagaacctatgatgacaaggtaaaatgattactgccaagtttgaggccaacctaggctccatagttgagaccttgtctcaaaaaaactaagaaaatgaaatgagtagtattttcttatttaatacttaacttatgcatactgtattaataagggacaaattttagttgtattccttcttagataattttatacatgaaatgtatagtcttttttgttggttattttatttatttacatttcaaatgatatcctccttcccagttaaatcccctatcctccttccctgttcctccagcttctatgagggtggtcccctatccacccactcactcctacctcagtgccctagcattcccctatgctgggtcatccagcctctacagaactaaggggctcccctcccattgatgccagataagttaatactctgctatatatgtggctggagccattggtcacactatatgtactctttggctggtgatttagtccctgggagctctgggggttctggatggttgatattgttggtcttcctgtgggactgctaaccccttcagtttagctccttcatctaactcctccattgtggggtccccatgcttagcctgatggttggctactaacatccgcatctgtattggtcaggctatggcacagactctcaggggacagctataccaggctcctgtcagcaagtgcttcttagcatctgtaatagtgtctgggtttggtgtttgcagatgggatggatccccaggtgaggcagtctctagatggccttttcttcagtttttactccactctttttccctgtacttcctttagtcaggagcaatatttttgagatgggtgggtggactgatctctcagccaggggccatgcctaaccactggatatggttctctttcccctttgttgggtcttttggctagtgtcatccatgtgccatgtcatacataatatgtgatgtgatttctgatgattccatgtccaaattataggagttattgctttcttttctttttttctgtcaatcttcacatccatcgattgggcaactcttatgtatctgacttgaaaattgtttagtatttaatttcttctcacttccctagttattaccaccctgctatacagcacttctcaaaatgtatctgctacaaaactctccattttatattgtaagttaggattgtctacaagagcaggcctatgtaagacctttctattcccatttctgtctctattcctctttctcatgtcgtaatagtctctgcttgaagttcatctactataacaggtaatccttcttcccaggattttgtattcacttctcctctacctgaagtgttcatttataccatatccccctgggcagcttaacaccttacttccttctttctcaaacattaaaatcatttcactgtgagctgtcctgatcccccaattaaagttgcaaagctactcccactgcaaatgtagccaaattctatcttctttccctttccccatttatctgattatcgttgggctacattatataacttttgtctattattatctgtctattgctctaagatacaaatccaataaagaatgaaatattttctttgctcttttttatatcccaaatacctaaggcaatgtcttccacttgaaagttgctcaatgactacctaaactattaaaattatatctagacattgaatttatgtttaattatttatacattataatctatggatcaaacccaaggccttgaagattctctaccattaagctaaactctagtttctaaatttaaaatataactaaaaaataaaatcaagccttaataataggtaacaaaatgctaagtagttttaaaagcattttaattttgaagaattgattcttacaagtaatttttgttttaaattattaacatttaaaaatacatattttacaagatataacgataaaagatggcattaaattttaacatgttttaaagaaacattgcatattttgccaaagagttaaaatagatttagaataaatatataaagacatataaagagagatgaataaatatataatgcaatctgctggctccttttttgttttgtatgtgattgcagggctcatccctgaggaagactaatttctccatctctcggcagtcattagttctctgtagatttttgcctatgggagggatgccttaagattttccccgttctgcattatcatgtcattgttcaggtcttctttagaaggctatttaagaaaatgagtcatcaacttgagaaggaatgggagactagggaggggttggatataagagagaaaaggaggagtgatataattgtattttaattaaagtatgttttaaaaataaaattagcatatgaaaaattagcatagaaagcatccatatgatttagtgaataaaatgtccagaagtgataggcttcctcacagatttaactatgtggctcacgtttaaagaaatttggtgccctgacggtgaaagaaatttgaactattttttttctccaaatctttatatataatttctacttaccataatttattagctatgctcacttaggagctaagcaataagcaatcatttcttccctttcatctctggtttatagaaactcattctctaaggatggtttcccaaaaacacgtgagtatatggggaggggcaggaaataaaagtttcctttagatattaaatgccaatcaatttagcaaaaggtattcttaatatacattcaaattttcatatacgatcattgggaattttcaataatgattttggagtcactgaacatagcttaataccaagaaaaattctacatccataataggagaaaatagatttaaatgtcagcttctgattcaaataaaaataataatctttccattatcattattcacagactggaatttaaataggagtaaaagtgagagctaaatgtaatatggaccatatttcataggacttagaaatcatacttaattttaaaattatgctttctaaaataattgtgttgcagaaacctttcatgaaaaacataaatcatagaatgcaatggtatgatgttctcactgtaaccaatctatgcctttgttttgatattttacagcattaatttcacattttatctgctccctaagcagaattacaaaatattcaagtacttggaatttgctgtatgaactgacctcaattaacaaattagaattttcattcagaaatgaatattgctatttcataagctatattttacttgtgtattaaaatatttcaccttgaaatattaaattattagttttcagcttaataaaatagcctaatcaagtccccaatatcctactgataaaaacatataatttatctgaattaaaacaccacactctctcttcaaatgataaaatgagaaattgaaatttttcatctacaagctcacttatgctttaataaaatcacaggataaatgaagtaacatgagtctcacaaaccactttatatatttctcttaactttaatcgatgccttttattaatgtcaataaatgaaagcttttttccctacaaagctgcatcttctgggttcaaagcagagtcttctacctttatggtgcaagttttcaaccaaattctctcttatcaataattaagttcctgggattggagagatggttcagttgttaaaagcactgactgatcttccaaaggaccagggtttgacatttaatgtatatgtgtgtgtgcgtgtgtgtgtgtgtgtgtgtgtgtgtgtatgagagtataattttaggtaaatatacaacaatacaattctttgagatatggcggtttttattaattgacctttctcccctctctccagttggatccccttccccatttttctgtttcccacttcatattattaatcccaaagatgaaggtagaaagaccacagacctgacttatcatggccaaactaattaagcagcaattcattaaagcaagatttttatccatgtatactctctgctccctctaaggcaagttttgaaaggtcagtattggacatgaagaagacaaggtttttacagctcagaggtaggggctttctaaatggggtatttggcaggtaaaatagatagggttacaggagaagaatataagcaagcaaattatttgtaattaccccctgaaacaaagacatgaggtagtcatagcaacagacattcaaaaaactcttttgaaacaaaggtagagttgcaagattgttgtagacaactttttgaaacaaagccatggttgccatttcctgaaacagccagtacagaagatatttaataataaacagatataagtctagtttttctctttataagatgacttttaagtctaagatgaagacaagctggttcatcattatcacatgccttttatcattcctatttctaaccagttcctccatggtccctttatactttcctggtttttatggttactccatgttatatactaacacctgatgatttggaactagggatcatagatgaccacagatgtgtgtgtgtgtgtgtgtgtgtgtgtgtgtgtgtgtgtgtgtgtagagtaagatgtcaagttttttagggatatgccaaaggatgacacagctaagtcatatggtagctttgatttaattttttgaggatgcactctactgaagtatagggtgccagtaccaatttacattcccatcaagagtgaaccagttcctcttttctcagaaccgtgctagcttttgatgtcagttgtttcattgatctttgctattttaactggggtgggttgaaatgtcaatgatgttttgcgttacattttcctgattgctaaaaatgatgaagactatttaaggtctttctcagccattttaatttcttctgttgaaaacctctgtttagatccctaactcattttttaaaattgaggtatttgttttccttgcctctgactttgggggggggttgtttggttgtttggcttttgatttttgatacccccacccacattctggatattagtctcctctgagatttacagctggcaaagattctctcccaatctgatgttttcttcttcattcaattcattcttttgtatagaagctttttggtttttaagttttatgagtatccatttgtcaatcattattcttaattcctgaacaaatcaagtcctgttgaaaaagtccttcctaatacctctatcttgtaagatattgcctacatttttatccagtagttttagtgtttcggttctcaaaaaaatgtcagtgttccacttggaattagactcatatctatcaacttacaaacttgtttttttttaatgtgcatgttagatatttaaatatcacatactaatggtggtttcttggagaataagtccttgcttttatatgtgctaaacaaactgagatttatgatatgcatacaaatagccacatgcactcatttatatgctgtatgtactgtatgtgtgtgccatgtaatccctaacttcaaagaattatttatgtttaaagagtgttcataatgaagacaataagacccaaattactttgcttatagcatttatattctgctttccctttttattttctaactgatcctttcctatatcatttacatatattgctactacaacttaatcaaggcctgagcttggcctcatgtgccccatcacctcagagttaagtatatcagagtctataatcacagttgtgaaaacttgtaacagagtgtgtccatagctttaaactgattcacacccacaggaaccaaatatcaacaattcctaacagttgggaaaagcaatcccagcccactcttgcacctttctaaatcctcattaagtgtttcttagccatttcaataaggcaatgctttctttaggactaacaaattcctgactgttactaaaatgagctaagagttcccactattctcatcaaattcattctgctaaagcaaaaagatggttatttaatcctaattatgctagcagcattacatcagaagcctacagagaagattcctgttttccaaactgtgtatgactaatttattctgtactacttagcagtacctgcaactgagaatttgaggcttgccccaatttactttgttttactcactgtagatttcaaatgcatggcttctacccagccattagtacctagggcataaaacctaagcatccaggtctctaaaccatataactcctctgatcactcaagataggccaggctctaactggcatcagacatggatatgctcattataatgagcattgtcctccctaaattctacctttgacatctttggtttgtttcttcctggatcaacagaacaaaatcagggattcttgacaagttattctctgccagtgaaagaagccagttcaagccagagtagagtatataaaagcaggtttattgagaaactgatcttccgtggtttactagtcccaaggaaggtcagggagttgctgtggggagggagaccaaggggagtagggagagacagaacatgtgggtgcatgtaggttgaaaaaatgttgagggggggagagagacagagacagagagacagacagagagacagaaagagacagagaaaaccaaaatgtctggattatataggaaagagtttatgggggaggggaagcccagaccttgagttcaaaatgtcaggtagtgactgagggatgctgggagaatctggaggccaggcccactttggtatgttattatgtacctcagtggtttgtctcaggtctgaatcccagccattctctattctgctaagcagctgtgtcataatgaaaatgtgttttaaaaatagattgggtagttttgtgctgagcctcatgacctgaattctatcctgacgaactgggatcaatcttcagactccacatggaaggaagaaagaactgactcctgccaggtattttctgacctccacacatgtactgtgcacaaacacatgcacaaacacaaagacagacagacagattcctcctcccaatacagacataaatgaatggatataaattagtaaatgtgtttttgtaagacaagataaaaaccttacaattatagatatatgttttaagttataccaccctccgttccctgaagaagatgcatgctttcagactttttcttagctcaggacaagcattctgcctttccaaatagcaatcagaatgtactgattcgtctgcactcacaagctttttagtacaaagtaaaaatgtggctgctggtcccaaatacctcccaagaagctctgaagctgaaattcatgggatgacattgatggacatcctttttcaaaaagggcttctgtctgctaggaactacctaagagataatgacacagaaaagaatcaaaaattcaaatcacaattaaaaaaagaaagaaagaaaaaccttagggatttaagtttcagttaaaacaccctgaaaaatctttttcagttatcttattttgtgatgtaaagaggtaggggatttgaagggatgaacgcaatgactttccttaaaaggctaaatcctggctgggcctataggcacttttagagcaatttcaatacccaggcttacaaaaagcgcacaacatgtctataaaaatgattttaataagtattaggaagagtcaaaaaggtcttcagtaattgtgggtgacaataccatctcaaagtattagtatctgttttgctagataaagaactaagcctttgttgagtagtacacattaataatacgcatacctcatttcatataaattttaaacctagtgttgaaggagagtcttccaggaaaaattatgattctttatacttatataggcatagagctcatagagttccaaaactattaagcataatattttacttctgattatatgtcacattttcttttctcattcaaaagaggtgtaacatactttctatatgtttttcacatttatttcccttagaaactctcattaaggtcaataattacttcttgaatgttgataagaatatgctgttggaaatggttcctaaaaacaggaccaagttttataattttctggcttcagacttttgctttattttgttttgttaacttgttaccttgtctgtttatttgtgtgtaagtgagcataaagttaattctcacaggaaaaaaatatctgtgcagtatttgcttatagacttaatctctgagatttttacactattgctaatgatttcccaggtgtccttgaatctaaaatagcaggatttacagttcataaatttttatttagttgcaaccattgtttgcaaatgactttacagtctggtgaagaggcaaagaaataaaataaagatgtaatgaacttgaataaatggattgaatttagaaagtacattgaggatatagcaaagacttgcaattttagtcagctttgcattattactacaatgaaatacctgcaacagggtacttatgacataaaggaagccttgtcttgctcatgctgttagagttttgagactgtgacactgacattagcttagttctcaattaggtctcagttctcaacatggcagatagcaaaatagaaccaacaggtgactgcaactgaagccaagagcaaagagaggagctaatatctcatatcccaccttaagacttcccactatgtcccctcaccacaaactactatcatctctcaatactgctaccctttgtaccatgacttcagtcacagtatatttcagggagactatgtaaaccatacctaaacctttcagcattttagtcactagggaagatgccaggggaagtatataaatatatagcagatgaattataaaatctaatactaacaatttcttaccatcgtttattgggccattactctgtgttaacttatagtatactcagcacttcatataagaattagtatatctgatccttattaaaaacttgcatttaaatgttttccacctagctttgcaaaagaaaagagcttaagtgatataacttgattaatataagacaagaaaagatagttccttttttgaaacaggggccaagatttcaaccaatacatttatgttttagagtacaaattgcaaattggtgttgaagtaccaaaaccactctgggaacctgttttatgcagcctacacaacatgtttcaagaaaatatgggtgtgattatatatatatatatatagagagagagagagagatggaactgttaactggagtcaccattcaattttgttttaccccatcttgacatttagaattttgctctctcatttaaaattacaagtttttcttcacagttatatatacatatgtacttaaatagcttatttaagtaacacttatatgcatatatacttagataaagtattatatatacttaagctaaagtaagttatatataatactctttctaagtatatttgtatatataaaaacatagaaaataaattagcacagcatttaaatatggttccattgttcatgctgaagaattaaaataggaatcactttaggaaatactacaatatttaagaagtaattggaggcactactttttcaatgttaaaatgacacgttcttggaagttccttctttctctactgatttcaggttttgctttccttgaacaggcacagccagagggattcccttatgtaatcttcatccatatgtctctgccaaccaattaattgttcattaatgcatcaacctaggtgttaattggttgatagacagacattttaaaaaaagaagttgtgaatgggtcccagtggccctccttcctcttcagtgtgaggatcatagtgaagtcaatgtcaaatgttgcatccccaacactgtgatgaggtttttttattcatgttgtagtgggattacttttgtttatagctgatgctattttgcacttcttttacatagaattgttaatattatacgtcacaaggaggacatttgaaagaatgattacccaagagaatcatctggttcaaaaaaactgtatttaataggttttctccaccaaagaaataagccaattcaacctgaatggaaaaaaaaaaaaagaaaaaaaaagaaaaaaggcaggtttatttgggaatggctcctgagcaagttcaccagcctcaggagactagaccagaaaaaaaaaaaaaaagtgtgccaaggctatggtacagggttttgtttgtttgtttgtttggtttggtttttgtttttttttttttttatagactatagttgaaggaaagtgttgtgttggccacacgttgggctagtgaccagatatggtcacctaaggaggacatttgggtggctggtgacttcaagagaaggggttgtaacagttgttgtcagcaatgtcaagcatgaggcactgagctcttggtgccttttctctgttaggcttctgagctggacagttggatagagagagggaagaaagaacttgatcagatcacgggagagcaggcaagctggaggctccaagtgaacagaattgtttcttaaaagcttagaataaaacttagctgaataaagaatggttaaaattcagatgagatggctggtgattcttacgcatgataggtagtcttcctattctgaagacatagaaacaactttaagaaatattttgaaaattccaactaactgttgttataattgaatttcacaagtttttgttttgttttgttttttgttttttgagacaggatctcactaagtagccatggtctcccttgaacatttgtgtaaactatgcagtcttctaactcagagatctacctacctctgtctcccaaggactaagatcaaaggcatagggtaccacggccaattctttatcgatgtcttaatttcttaaattaaatagccttttcaattaaactatttactagtttagcatcactagatcagtaaatgtttcagtttttgttccaaaattcctagtagtttaggcatcactagatcagtaaatgtttcagtttttgttccaaaattcttagtagtttaggatttaacgtagttcacttctttcaaaagacccaatagatttttttaaaagaattctagatgttttaattttctgttaattcaaatacacaaaaaagggtgaaaagtgaaaacacagtgaatcctacaatgcacatataataaataactgatattttacaatgtattttagctagatcacagatttatttttcttatctcttttctgggcaaaggatagtctcattatgtagtcctatagtcctggctggtctggagctctctctatgtatgtggctgttttaacctctgagagatctgcctacttttatttccatagttcttggattaaaagcttgagccaccacacctagtttatttctctctttcttaaactgtcttttctctttgtgctgcaagtgctaataacagcttccttcatttaatatattttagcaattaaaaaaattaaacataaaattatatcatttcctagtttctacacctctctgacttttttgtctgtcttcctccttccaaaatccatggcctccacttcttaaatagtgtacatactaataaacttataaatacaaccactgaatctgtccaatgttgcctgaatatatttctgtatagctgaccactttgtattgggtaaccaaccgatgctcatccctggagaagacaaactccccctctctcagaagctgttcattgtttatacctcttcatctgaaggtagagctttctgactttctttcatctacactggaacattaccaactgtaattcagattgctcaggtcttatttaggcaatcatgttattgagattctataaatatagctagaaggcacaatttttttgagaatttcatacttatatacaatatgttttaatcatattcaccctctattcattactttaacttctccctgatccttcctctatcatctacttccctaccaacttttctcttttctttttttataagtcactgtgtcccatttatgctgtctgcctactcatagctaggaataggaccttaggagcccctctccagtccatgctgtaattttggttgtcttattctggtttagctcctgtgcaggcagccacagcactataagtccatgagtgcaattgacctgttgtgtgcggaaaacatgatttcactggtatttaccctgaccttggctcttacaatatttccatcttctcttcctcaatattccctgagattggagaagagatatgatacagatgtcccctctataactcagcatcctacagacacatattttctgcactctatcagttgtacattaattatattttctttaattgaaaacttcttacaatatactctaatcatgttttcctctacccaaactcttcccagatcctccccacctcactgtctccccaactttacactttgtctttttctgattttcaaagagtaaaagaaacaaacaaaaaaacaaaaaaaagaagaatcatacacacacacacacaacaaaagtaaaaatcaaaacaaataagcaagaggcctatggatagggagccaaaaacaaatgaagcaaaatgaagcaagaagtcctcaaaaataccactgaattcatttggtgtaggctaaacattcctgggcatggggcctgccctggagtctggctgctgtatccagtaagactccattggagaaaactgtgttttcctttcctttccttacccacccactcccacttcttggccctggcgttcccccgtactgaggcatataaagtttgctagaccaaggggcctctcttcccaatgatagctgactaggccaacttctgatacatatgcagctagagacatgagctcagggggtactggttagttcatatttttgttccacctatagggttgcagacccctttagctacttgtgtactttctctagctcctccattgggggccctgtgatccatccaatagctgactgtgaccattcacttctgtgtttgccaggccccggcatacctcacaagagacagctatatcagggtcctttcagcaaaatcttgctggtgtatgaaatggtgtcagtgtttggaggctgattatgggatggatccccgggtatggcagtctctagatggtccattctttcgtctcagctccaaactttgtctatgtaactccttctaaaagcaactcattgagagagcagaaccctgtattaagggtaaaagagttatagctttgttgtatcatatgcatcagctagtgttctgagttgcagaatagtagagtaatatataaatcttactgcatgctggggaagaaagaagtggggagggaggtaaggaagggaaggagggaagagagggaagaggggagagagggatgggaatattatttttccagagaattggtatacacaatctgaagaaataacaaaatagtctccacaggtgtctctacatctaatgctgaaatttaaaattgagataagacattgtaaacaaaggtgaatgccgttaggtacactgaaacttgtgttgactcaaagagcaagcacatggttgtctagtctagcagtcagacactgaaggaagatctcagcgggaaaaagagcacttgtagctgctgtttcatgctaatggagcaaggtagcatacaacagcaagcatgattgtattaacttacacacgattacattgttgtcctcctttttactatccactagtgttaagagaatttcttttgtaacctgttgtgaatagaaataggtaagtaaagggaattctgggatatacaatttgactgggttaaatgggcattacaaagctatcataaattttagaacagttgaacaaacagagatgaaaatgttcacttaaagactataaatattgttcacattgctttggctctcataattatcacacgtgatagtagtatattgctactaaataaacttaaatggaagtgtcaaacactgcttatgaagcgaggggctaatagaaaaaggaagttagtctgaaaataagtgtcgactcagcaaaactgatcaaagcttttcagctgcagtaatgaagcacatagtctttttctttaagtattcactttacatcctgattactgctccctcccagtcaccccttcccatgatccttcctcctttcccatccccttctctgagccagtgggagtgcccttgggtatcccctcacctggcacacccactctcccactgaggctagacaaggcagcccagctagaagaacatatcccatacgctgaaccagctttagagatagctttagctgctccagctgttcgggacccacacgatgacaagctgtacatctgaagcacatagcttttaaacacagatgatcaaaataactcttctcttattcatgctcttttaatgttgaattcccaacgaggattagggatctgtagtctataaaactatacttttcaaggcatatttcaaatcacagatatacaacataataattaaatagcacttcacaatttcaatactattgtttgagaattccatgcatgcatataatgaattttcacatgactagaaattccggctttgttacttgatatagctcatttgacactttattcttattttctgttttgctactttccgataaatgatgagaacaagcccagaaagcttaaatactcaaaatgatctgatcaatcagatcaatgagcactttccttaatccaaaatgacatttggctcagaacacacatcctatctgtagcattaacgattaaccttccgacatgtaacacacttgtggctaacaccaagagttaatgagttgtaaagcatcacctagatatggttttactcttttttctaatttaggctagatggttattgataggatttcctgcaaaagatttagatataattgctatattttttagttatatgaattatactactcacataagcatatgaaggtcagctactggcagaaacacacatttatttgtatatccacaagtagaatactaatatgaacacttatataaaaaaaaacttggagaaaatatttatgcaatgagtaaagtagctttttcctaaagataagaaaatctgcttattttaagttccttctataactttcctcttagagaaccgcttatattaaaaatttaagtcacaggcaatagtaataataatagacacaaaaaagaccagtaaattatattcttctaaaagaaagtcgtaaaaatattttcaaatgataacatttattcggcgttgacaattttcatatactactttacaatcccctttcctgagcacatcttgagggttaagtcttgtaagctttgcaaatgacaggattcacttaaaagcatgtttttttttttttaaagagaaaataaaaactctcaacaattcacagaaaagtaaccagtctgtctgaaagtgggagatgggtacttatatgtgtgtgctttaatgagatgcttgcatcagcaccaaggccaggagcaaaggcaaactgtgagcagagaagggaagtgataaaatatgtgatagaaatcccaaaaggaagaaaagctttctgaagaaagctgaagcgtctcaagaagtcatatgcttggatataataaaatactttgaagcataggggaaaaatagctactgaacctgaaattgtaggatcagggaagaagaataaaaggcagaatataagggtttctttcaagtgattttaaagacaccactatttgaatggactaagatgacaggttgcaaaaggaaatgatgtttctttcttaccaatgaaaagaactgaaatatctttggtcatagagtgataatgaaataacagggaattcttaaagtactggaaatatccacataagctacaaaattctgaaacttcctgattaattcagcacagaatattccctcccattaggacatgtagtggtccaaactactattgcagtttagacattcagacagttacagcattaccttctatggattatagacaaagaatacatttgtaaaaatatttcgctggggatttagaatcagaagctgtcagacatgttttactaagctgcatgaatgaataactgaaatacccacagtcttactgtacagttttagtataatggggggagggttgtcctcacatcaggaaacaagaaagcatcaagttcactgactactcatttacatcttaaataataaacaacatgcatgagctatcactatatcctgcactaaccatgttttataagcttataaccctctaaaagactatttaattaacctcaaaagccaataaacataaggaaggcaggctttgtgcatatatctgagttctctatttgatctttgagagttaggacactcagacaaacacaaaaatttgccaaagtggatttttaccttttacaaaaactgttctcatgaaaacaaacatctttgtaagtcacacgggctcatgcacttgaaacatagtctatttacattgttacctttaaataaacaaatgtctaagaaaaggcggtgtagtgttactctaaccaaagctagaagcttttgttttagttttccttttttgcacatatataagttggacaattatagacgtggctgtggggtcaaataatacacagttgtgatttagcctgccaccataaaaactcaaaggcaagaagaaaaagaatgatcatgtaggtactgataggaacagacaatgaaaataaataaagctaccccaaaatacactatcttctgtaaggctgggtttagagaagacaacataagcaaaaaaaaataaaacataagcaaaaaataaaacaaaaataattttaaaataagagatgcaatgtatgaacacagtcccaagtagaatattataacctctgtgaatccatacttagcaaagataagaattatttacgtttgaataagctgatggaactatttcattattccccacatcactattgtcccctttgccaccttctttctgttttctactttccctatttctgcccattcctttcttttcttttattcaactgcttatggatactgaatgctaagttcttggctgattactgactccagataaatgtttcctctacatatttataatagcttgtttaaatatagttggatattggatagtaataatttgctttaaaagttcaagactctagaataggaatgtatcacagaggatgaaggaatcaaggaatgatatagtagagtgactgtacaattacaagagcaaaaatacaatagctattttttgtattatttttattaagtatttatttcatttacatttccaatgctatcccaaaagtcccccacacgctctcccacccactcccccacacacccactcccacttcttggccctggtgttcccctgtactgaggcagataaagtttgcatgaccaatgggcctttctttccactgatggccgactaggccatcttttgctacatatgcagttagagacacgagctcgggggggggggggggtattggttagttcatattgttgttccacctataggattgcagatgccttaagctccttgggtactttctctagatcctccattttgggccctgtgatccatcaaatagctgactgtgagcatccacttctgtatttgctaggccccagcatagtctcacaagagatagctatatctgggtcctttcagcaaaatcttgctagtgtatgtaatgctttcagcgtttggaagctgattgtgggatggatccctggatatgacagacaatagatatttttacaagatgtaacaacaaaattcatagcatcacaaaatcacaaagcctctgtagtcacaatatccaaatgtctacaacagaaggatatgcattttgtgcatcatttaaaaaattttaaaacaataaaaattgttgatagttctgatatcttcttcagaaagcaaagatatcatggcttcttctatccactattcaactcaggaacaaatttattcttgcttccatctctcagacattgttaaaattcctaagtacttccttgagaaaaatctgcttcaaggcagtgaaatgaatttcattgtgctgctacctttcttattaatttatcttatacacatcttttcaacactcatgtgcaagatcctgaggagcaagccatcaggtgacacagtgtggcaaacatttttgtgcccctttcttcacctttcattattccagatgccttggactttgatttgacacaaaaagaatgcagccatggagaacttaactatgggtctttccaggaacctgtgaaccactccaaaataatgtggtcatcttattctcattgtcctgctttcctttcttcaaatttataagattccgtctctgagttggatctcttgtctatgacctctctttattccatcaatggagaaagcagcctctatagcttactcagatgcaactctctgattctggacttgagtagattgttctaacttcatacaagaccatcatttatacaaaggcctctaccccataataacagtaattcttgtataatttctatcagttaatgagcactctcatgaatactatgaacatgtattaatttggttaactgtaatttattttagaaacttaaatcttcttagtaatctattgccagggtatgcatggctttgatcttacagaagtgggtagcaaggtaatttgctgcagaaatctcaccaaagagctggattagttttgcaagttttaaaatagttgccttgttcttgtcttgtgattttgtttccttgaagtatgcgcagatgtcagatgttgcaagaacaaccttctcaagtgagattgtatcatagccagtccattccattgcttttgcattctttcattgttctcagatgactctcatttcagaggttctatcaacagtttgatcttggcaactctttactgacaatggtcctagttcaggtttaagtacaatgtcttgaagtagttataaaataactttcttgagtacggcaagggcagataggaggtacagtgtaaaagacatagagacagagagagagacagaaaaggaattcttttcatttaatgtttttgaataaaggctttctggaaaaagaagctattcgctataactaatgacaaaagaaaaatatgttttgtaaaccactatgcttttatcttaagtggatagtctctggcaaaacatttattttttttcaattaccatagagttattttaatatacatgattaatgatccaataaaatttaaatccccctactactcaacatcttatttaagaaaaaatcctcactatttcctaattgcaacacgtaagatatctggatgctgatagtttttaattagggcagaaattttcttttaattagaaatgagtttttgtttatttgtttgtttgtttggtaggttggttggatttttatttttcattatttctcagtaagttcaagagtgtcctctagtggagacagactctctggtctcagcagttttagaaatgactaaattatttctaattagatgcttgcattaaataagaaatgttcctacttagctgattggaatatgctagttgaagggaaaatgtattcttttccctttaagatatgttcactacgtggcctagttgaaaacctgcagtgtgacaagcattgttctcatttcagatagcaaatgattttttatgatcaattttcgtgcttccttcagaacctggtgagattgagctgacggtgcacctgtctgccaaagaagcagcagaagcatttagtgcaatttactgtagcttttacagatatcaactggcagcagcaagaatgccattaccttcaagactccagctctggctggctgatgcagccaatgtgcaggagtcccagaaacacagcttatagcactctctcttgttatttgaaagaaattaagtagagaagaaaattaaatgaaggtctgtctttctcctctgacttctggaattctaacactaatatcctacatgtgtagttaagcattagtatcagtgctgttatgaagaagtggtttcttttttaataaacaaatggaagaggatgagaatgagctgcaatgctagggtctctgtgtctctgttagaattgccttatcagaaactgcatgctacaacaaattagaagcccaaagaaaagatggatattagttcctgataacaagatgaagattaaggtatacttaaagtatgcacaggtaattttaaaactgattcttatatttagaaaagactcaaaaaataaggaataatattggtaatgtcctgtcagatccatattatgtacatatagatgttgctgatttttatagctcaagtatgcaagcaccaatcatcgcattctctctttgagtgtttatttatttatatgtttttgtatacaagtgctctatttgcatgtgtgcctgaatgacagaaaggagcatcagaccctgttatagaaggctgtaagctgccatgtgtttgctggaaattgaactcaggatctctggaaaagcagccagtgctttcaaccactgagccatctctccagccccttggcattcttgttaacagatattttcagaaaaaatatataatcatgactctcaggcagtgtaagaagaatgaattttagaaaaaatgtatgcatatgatatgagaaagccaaacagatgatgtcttgacaagggaaggtcagaagagcttatgtcaatgtaacaaagaatgttgaactaaattgtaaatagagatgataacattattttcccctagattccagaggagacatagaaaaaaaactaatcaatctaatcattaccagactaaaggaagtgtccatacctatcagttacatgaattcaaaaccaggatccaatatccctgaaagatgtaccatacactgacaagtcatgtcccaatacgaactgtttctgccttcattctttgcaaacagaatctaatgctatagcttggttaggtcaatgccccagtagtaaattttggttccttccatcagctactactttatatgccttcctccctccagcttccctgtttataagttcaaatgtttctcttccctttcttccttcattttttttttgagagatagaaaatgatagggctgtttctgaatccttatgttactctatatgaactctaaagtaaaataaattgttctaatgttaactgataactttaaccacttgaattaaattatctgaagtgctggttaaaagtccaattctctagagtcctctcattttgtcaaaatcaaaaatttgtcagagaatgtcttagttacttttctgctgctgggaaaagacaccatgtccaaggcaacttataaaaagaaaacatttaatggggggctgtttctaggttcagagggtgagtccattatcactatggcagaaatcaggcaggaatagtgctgaagcagtcgctgaatatttacatcctacccataaacaggaagcagaagggggagggggcagagagactaacagtgtcagagacacaaggacagagacaaagacagaggagggaatactgggcctggtgtgtggacttttgaaacttcaaagctcacctccagtgacacacctcttccaataaggccatgcctcctagtccttccccaaacagtgctgacccactagggatcaagcattcaaatatttgaaactacaggtaccactcttattaaactgtcacaggtagcaacatattttagcaaacattgaatatactgtaagtcagtgagtaaaacaacacaaaagaatgaacataagtaatctttaaaaccatattctctcatctaaatgaatatatggctgaataaaatttaaaagagatatgaatttagaaatttatagaaaaaaacaacaaagtaagtggtagtatttgggattataaaaataacaatcttccttggagcttctccccaaagctagcatgtgaacctctttcttccatactgagaatgaaacccaaggccacagacatactagggggaacattctacccatgtaccaggcaaagaataaccatctgttaattctcatcagagactctaaccaaactgtcctttcattgtttaacttttaacagaaaatatacacatatatgctagaaaacaaacagtaaagaaaaaatacaatcatgctgtcattttagttgtctttgtggttttgacattctgatgaaagctgtctggatatgtttttaaatccatcaagcttgaaattgctgggctttgtatctttcacttttaagaaacaatgttcccatactgttctaagaaataatatatttcctcctaaatcgtatggttgttgtacagtacttaactcattaatttcacatccatttgattgtgttgcttgaaactaaagttaatttctggtttataattcttcattatattatttgaaactatatttccaaattactcattgtgtggtggtaaatctaatacaatttctaagcactataatctgtttcaggtacctacaggggcagattaatacttttaccatttaaaaaaatacatctattttaaaacattttattttttgagattataatataaatgtgtcattccccctcctatttgtgacctccacatacccacctatttgttctattactaattaattaccttattttttattaattattgttacatgcatatagctgggcatggtggcacatgcctttaatccaaaacactagggagacagaggcaggcagacttttgagtctgaggtatgcctagtgtgcttagaaggtttgaagtcagccaggcttatacagtgagttcttgtctcaaaaaaacaaaacaataataaaaatgatatataaaataaaatacaattcatttatgttttattcaacaatttgatcttcataactgtcacaattatacttctttaagataattattgattatatctaattcttaaactaatataaaataattttcataagttctacatcttaactggaatgctaataacaataacatcaaatacaacatataatttgagagtagatttgtttgtttatttattccttgtgtaaacagaatcactttaactttataatcaagaactagaaatcatgcataataccatttttaagatatagcaggcatagattgccacagagttttattactgaattttacaaactccagagagtaatcaatcaatgtcttctagaaaataatattaaagaaaaacaattaagtcacattccctatagctaagtaacagtatattagcattctccaaatcatgaaatatcgcttaaattttcccaacttatgagaatggggagttggctctgtgtcctagagcacttgttgggcattcagaggatcagggttcaagtcccagcacccatatggtggctcaaaatcatctctaactccagtttctagccttcatgaacaccaggcacatgaatggtgtacataatatacataaagactaaactttgtctgttgcttatttttaaaggctaacaatatagccaggtatatccttgcaaaatttcagacaataaaatgctatatgtcttttaaatttttataaagatgttttaaattttaagactaatatccttcagatccatgttctctatgcctttattttacatgttttagctcacaaatctttttgtttgtttgtttgttttattatttttttaacactccagattttattcccatattagtccaccttccaactgcttcacatcccatacttcctccccactcctctgtctcaacgtggatatccccacccccaccccccaccctatcagacctctaaactccctggagtctccattcacatgaaggttaggtacatcttctctaactgaatccagaccccagcagtcctttgctgtgtatgtgttgggggtctcatatcagccggtgtatgcttcctgtttggtagtccagtgtctgagagatctcgagggtccagattaattttgactgctggccctcctacagagtcatcctcctcttcaacttcttccagcttttacctaattcaacaacagaggtcagttgcttctgtccattggttgggtgcaaacatctatagctgactctttcagctgcttgttgggtcttttggaggacagtcatgaaaggcccctttttgtgagcactcaataccatcagtaatgtgtcaggctttgggacctccccttgagctggatcccactgtgggcctgttgctagatcttcttttcctcaggcccctctccatttccatctctgtaattctttcagacaggagcaattatgggtcagagttgtgactgtgggatgacaacgccatccctcatttgatgccctgttttccttggaggtgggctctatagtttcctctccccactgcctggcattttgtctaaggccccctccctttgggtcctgagaatctctcacctcccaggtctctggtgcattctggaaggtccccccaacctcttatttcctgagatagcctgattccattctttctgctggacctcaaggcttcagtccttttcacctacccaataccagatcatattcccttcttcccttccccacccccttcccttcccagatccctccctctctccccactttgaggttgctttgttctctctcccaagtaggactgaggagtcctcacttgggcacttctgcttgttgatctttttgagttctgtagactgtatcttggatattcggtcctacatcttattgggctcatatccacttattagtcaatacatactatgcatgtccttttgtgtcaaaagattacctcaatcaagatgatatttttttagttccattcatttggctgcaaaactcagaatgtcctcgttcttaatagctgagtagtattccattgtgtaaaatgaaccacattttctgtattcattcttctgttgtgcgacatctcggttgtttccagcttctggctatcaaaaataaggctgctatgaacataatagaaaacatgccactgtggtatggttgggtatcttttgggtataattactgagagtgctattgctgggtcttcaggtatatctatttccaattttctaagaacttccagattgatttccagagcggctgtaccagtatgcaatcccacaagcaatggaggagtgttcctctttctccacatcctcaccaacatgtgttgtcacctgaggttttgatcttagccattctgattggtgtaagatggaattacagggttgttttgatttgcatttctctgttcactaaggactttgaacatttctttaggtgcttctcagccatttgagattcctctgttttgaattctctgtttagttctataccctattttttttgattgggttgggtttttgtttgtttttttttgtttgtttgttttggtttttttgtttttgttttttggtgattagcttcttgagttctttatatattttagatattagtcctctaacggatgtggggttagtgaagatttttttctcaatctgtagattgcccatttgtcttattgactatttcctttaccttacagacgctttccagcttcatgaggtctcatttatcaattcttgatcttagagcacgcatcattagagttctgtttaggaaatttccccctgtgccaatgagttcaatggtctttcccactttcttttctattagattcagtgtatctggttatatgttgaggtccttgatccacttggacttgagcattgtgcaaggtgacaaatatgggtatattttcatttttctacatacagacagcaagttagaccagcagcacttattgaagattcttttttccattgtatatttttggcttctttgtcaaagatcaagtgactgtaagtgtgtggttttatttctgggtcttcaattctattccattgatcaatttgtctctctctgtaagaataccatgcagtttttatcactattgctctgtagtaaagcttgaggtcagggatggtgattctcccagtcattcttttattgttaagaagtgttttcactattctggtttgtgtgtgtgtgtgtgtgtgtgtgtgtgtgcctttccagatgaatttgagaattgctttcagtgtctttaaagaattgtgttgggattttgatgggaattgcattaaatctgtagattgcctttggtagaatggccatttttactatattaactgtgctaatccatgagcacgggagatctctcaattttctgagatcttctttgatttctttcttgagagacttaaagttattgtcctacaggtcttccacttgtttagttagagtcatcccaagatattttatattatttgtggctattgtgaagggagttgtttccctaatttctttctcagcctgtttatcatttgtataaagtaaagctactgatttatttgagttaattttatatctaaccactttgctgaagttgtttatcagctgtagaagttctctggtagaatttctggggtcacttgtgtatactatcatctgtaaatagtaatacatttatttttctttgtctatttgtatccccttgatctccttttgttttcttattgttctagctggtacttcaagtattatattgtatagatatgggggaagtgggcatccttgtcttgtccctaattttagtgtgattgcttcaagtacctatccatttaattttatattggctgtgagtttgcagtaaattgcttttattatgtttagatatgggccttgaattcctgacctctctggtacttttaacatgaaatgctattgtattttgtcaaatgttttttctgcatctaaggagttgattatgtgatttttttcctttgagttttttatatagtggatatagtggattatattaatagatttttgtatattgaaccaaccttgcatccctgggatgaagcctatctgatcttggtggatgatggttttaatgatggtgttcttgtattcagtttgcacaaaattttattgagtatttttccattgatattcataagtgagattggtctaaagtactcttttttggttgggtccttgtgtggtttatatatcagagtaattgtggcttcatagaatgaattaggtagtgttccttctgtttctattttatgaaacagtttgaggaatattggaatcaggtcttctttgaaagtctggtcgaattctgcactaaatccatctggccctgggcggtttttgtttgggtggtttttaatgacttcttttatttccttatctttggtatgtgatatctgtctagaaaaccaatatttcatctagattttccagttttgtttagtataggcttttgtaggaggatctgatgattttttaaatttcctccatttctgttgttatgtatcccttttcatttctgattttgttaatttggatactgcctctgggctcttagttagtatggctaagtatttatctatcttattgattctctcaaagaatcagcttttggttttgttggttctttgtattgttctctttgtttctatttggttgatttcagccctgagtttcattatttcctgccatctaattctcttgggtgagtgtgcttctttttgttctagagttctaacatttgctgttaagttgccagtataaaatctgcccagtttctttaccagggcactaagtgctatgaattttcctcttagaactgctttcattgtgtcccataagtttggatatgatgtgtcacattttcattgaattccgggaagtcttcagtttatttctttatttcttccctgatcaagttatcattgagtagagagttgttcagtttcctcatgtatgtgggctttctattggttttgctcttattgaagaacagccttaggccatggtgagctgatagaatgcatgggattatttcagtcttcttgtatcagttgagtgttgctttgtgaccaattatatggttgattttgaaaaaggtaccatgatgtgctaagaagaaggtgtattcttttgttttagggtgaaatgttctgtagatatatgttaaatccatttggttcataacctctcttagtttcactatgtctctgtttatttttctgtttcaatgacatgtccatttgtgagagtggggtgttgaagtctctcgactattattgtgtggggttaagtgtgtgttttgagctttagttaattttattttatgaatgtaggtgcccttgcatttgggacatagatgttcagaattgagaatttctcttggtggatttcccctttgatgagtatgaagtactcttcttcatcacatttgataactttggttgaaaatctattttattggatattaggatggcaactccagagcttgtttcttgggaccatttgcttggaagactttttttcatccttttactctgagatagtctgtctttgttgttgaggtgtgtttcttgcatgcagcaaaatgttggatcttgtttgcaaatctagtctgttaccttatgtctttttaaaggtgagttgaatccaataatattaaaagatactaaagacagatgagtgtttctattatatttggttttataggtggctttatgtgtttgtggttctctccttttggctttgttgtgagatggttaatatcttgtcctttctttggtgcaggtaccttccttgtgttggagttttccttccaggatcctctgtagggctggattggtagatagatactgtttgaatttggttttgtcctggaatattttgatttctctatctatgttgattgagagttttcatgggtatagtagcctgggctggaatttgtgttctcttagagtctgcatgacctctgaccaggcttttctggttttcataatgtctgttaagaagtctggtgaaattctgataagtctttgtatgtaacttgtcacttttcccttacaacttttaatattcttcctttgttctgtgcaattactgttttcattattatgtgacaaaatagggttttcttttcgggtcccatttatttggtgttctataggcttcttgtacctttatggtcatttctttctttaggttggggaagttttcttctatgattttgttgaagatgttttcaggtcctttgagctgggaatcttcattctcctctggttcaattattcttagatttggtcttttcattgtgtcctgaatatcctgtatgctttgggttaggagttttttacattttgaattttcatcgacggttatgtcaatctcttctaaggtatcttctacacctgagattctctcttctatctcttttattctgttggtgatacatttgcaattcctgatctctttcctaagtttcccttcccagggttacctctatttgtgttttctttattgtttctacttccacttttaagtcttggactgctttatgcaattccttcacctgtttgattgtgttttcctgtatttatttaagggatttatttgtttcctcttttaaaaatttttaacgatgaaaacaaaaatatacctaaaagcaaagcttctggaaaaaccatttgttcttccttctcttgtattgctcctcaaacttgaccttggcctcccccaacccccggccttgtgtttcaaatcttggtccctgaacacatccttgttgacaagtcttgtccaaggggatattcacagagtaccttgtgggcatgaggtggttgtaattattaactttcacaaaggacttgatcttggattgcttggcaattttcttcttacccatggctgctgtcacttttcaattccagccaccagggcatggctgtaagggtgatcctaggtgtcattgtgggtgcctgctccttgatgttgaaatgggcaagttcatgaaacccagtaaggtggtgctggtcctgacttgatgctaccctggacacaatgccatcatcttgaagaatatttgtttcctctttaagggcttctaccttacctgtatttggctgtgttttcctgtatttctttcagtgaattatttatatcctcattagaggactctattatcttcattagaaaggatttttaggtaagcttcctgatcttcaggtgtgttgatgtaatcagggcctgctatggtgggagaactgggttctgatgatgcccatgtatattgacttctgatgcttatagtcttgcacttgtctcttgtcacctggttattcgtggtgtttgttggtctgggtgactctgtctggagtctgcctcttttgtccctgggttgcttcaggtctcttggtaggcctgtatcactgactgtagcagatcttctgtggggccttccaactgcagtagggggcatcttcagaggggcagagaagctgctgatctgttaccctggctgcagtagatctcctgggataccttcagactgttgggtcttcagaggagtagtcaagatgttgtcctatatgacaattttctctgggggtggggaggcatgaactgtgatttctatttcactgtgtgcagcagaactccagggaggcttttagtctgttggatcaattgccctgcatgccacagaacccccgggaagtcttcagactttgatgtcagttgcccagttgccctgtgtacagaggaactcctgggatgccttcaagctgtggtgtcttcaggggagcagacaagctggtgatcagttgctcagctgctctgtgagcagtggatcttctgggatgactcaggatatggtatcttccagggtgcagactagctagcagtccatcccagcagaaaggactggacaaaaggcgagtggtatttggcaggcaggggttttggggggatgatgggttcctgagtccactgagttctcagccagctgcagctgtgggactttgggagtattcttaccaaattctctgagtgtagtggatcttctaggatccctcaggatacctatctctcacttcttaatgatattttctccatttaaatgcctgtacttatagactgagaaaatggacaggggtctagtaagattttttttgactaaggggtttgggagaggagtaatctgaaacactattttagaacctagtaagagcttcagttggcctctgctaaggaatataaagctcagttgcccattgtacaatctatgcatatttagcaaaattgaactgtaaagctagacattctctagaggttttttattagttataggcactgaacctcatcccaaaacttaaacttgatctttcaaataacagattgtgtgcattattgatatatgccttttatattctatatcttgattctgtttggcatttgttggtaatttatggacatggtaacaggcatttcagttgcatataaaataatggctctcctaaaaatttaaactcatgacccagtgtaaaaatgcacacacctgtaattccaccactaggaaagctgaggcatgatggtcctaaatttaaatccagcatggtttacaaaggaaagccttgtctctaaaacaatacctcctttaaaattaatttcacctgatacattctatagaaatatgtgcttgagtagttatcaagaatattaatgttctttatgtaaatctttatgtaaaaatgttccctaaaaatgtattaggttgggattctctagagtcacaaacttatggaatgtttttctatataaagggaatttagtataatgacttgcagtctgcagtccaactaatccaacaatgggcagctgtaaatggaaattcccagaatcaagtagtttctcagtcccaagagactatttgtttcagctagtcttctgtataagctggaaccctgaagaagtagattccaacatatatactggcaaataagtgcaagcagccagtgaaccttccgtcttccttcatccttaggtaggcctctagaagaaggtatggcccaaattaaaggtgtgtaccaccatgcctggatttgaaaattgctctgtccaagtctggccttgaactcagagatctgttaccccagtctgcctgggcctaagcttttcaaggccactatgccgcaagatctgggccacaggtgtgccctccatttcttgattttgattcattccaggtgtcgttaaattgacaaccaggaatcgccatcacaagaagtgaattaaatattacaaaattttaaaatgtttgtgtaaacagagtaacaataaagaaactttttctttttcattgctgaggatcaaacccaggacctggaacatgctatgggggcactttacaactaacctacagagtcaatccttagactttttaaagacagagtcttcctacataatattccaggttggctaagaatgtgcaatacaatctaggctgacctcagactagagatcctctacttctcaactcctgagattataggagtgttccacttaacttggaaagagcttcattcttgactctgaaaatcttgtagctattttctgggcttgcctgatctagttcaacaatgatgaatgactcttacatatagaaacagaatgtctaagagtatagtagaaaaaataaaacatgaaaaatacaacagactaatgtcttaaaatattagaacacatgttttggatttattacttgtgcaactgacaaaattcaaacaatgatactaattttagccaatgaaaacatttttgtttttgaaagtgtagaaccaagtgcaaagaatgcctatgactgctctttaaaagagtacagctaagcacattgcactttcctctttgcttatgctatagaagtcctaagcacaattttgagatacttcaattactactcctaacttggatataaggccctcagctccttggatactttctctagctcctccattgggggccctgtgttcgatccaataaatgactgtgagcatccacttctttgtttccctggcaccagcatagcctcacaagagacagctatatcagggtcctgtcagcaaaatcttgctggcgtatgcaatagtgtctgggtttagtggctgcttatgagatggatccccggatggggcagtctctggatggtcctaccttctctttcagctccaaattttgtttctgtaactccttccatgggtatttggttccccattctaaggaggagagctgaaggggtctgcatccctataggaggaacaacaatatgaactaaccagcacccacagagctcatgtctctagctgtatatgtagcagaagatggcctagttggccctcaataggaggagaggcccttggtattgtgaagatcatatgcctcagtacaggggaatgccagggccaacaagtgggtgtgtataggggagcagagtgggggagtagggtataggggactttaggggtagcatttaaatgtaaataaagaagatatctaataagaagaggccttcaatccttgggaactaccttcctggacccccgtgagcacagagtcatacacactgttatcagaatttattgttacatctaatggagagagttagcttactctaaatgtcagcacgcttttcagttcatcttttggcaatcatgcctaagtgttctcttacattcatgttcctggagtctcttacttgactcatatcccactcttatgttccacttgaagccagaaaattctacagctagactattgcagttgtgaaatgctggcttgagtaaataaaatggttgtgaaaggtaaaggatttttaataaatatagtattctggagatattagattcacttctatcttttagtcaaaaatttaaatttaccttattaaagtagtcaattaacctatgtatactactatacatgaaaaggaactacatgtaggaagtaaaatagtgaaaacaatcatctcctacatacatgtttgtaatttatttcaattaatattctatatttttattatcatgatttcactcatattaatgtgattttctacctaatattgtactttgctaagaaaatgttattccttatggagtcaaagtttcttagcagcactcttgaatctatgagctatagttgcactgtcccctcaggcaaggattttgttttgtttctccatatatcctttgatgtaaagtcttgagaaggatatatctcttctgtgattcttcccaataattcataaactcaatctaatcatgagaagacatcactaagactcaattgaagaacattctataggataatggatcctcttctaaatctcacaagtaactctcattcattaaataaaacatattgtaaaagaaaatgatacatttgataaagttgacaatgatggaaaatgcttggtcaattattcttttagctgtttcattaaatcaatgaaatgtccccattcttactagtcgatttgttttgttttgttttgttttaaatggatacaaatggttttatgctgtgtttccatcacttttctccacaggtggctcagccaacctcacctgcagagctttctttgggtacagtggagatgtcagtcctttaatttactggatgaaaggagagaaatttattgaagatctggatgaaaatagagtttgggaaagtgacattaggtaaaatattttttatacttttaaacatgtggagctgagttaacatttgctttgtcaagcaggggaagggtgagccaaaacaacaaagttattattttatctttcaattatcataacaaattctgtattactttatgtcaaacaaagaattgttgaggctgcttatgaaattacaaaatgtcaacatcatttacaaagaatctaagagtaattctttattctaaatatttttattattactgctttaggattcatataatatgtcttgacaatattcacaaacaaactccacttctctacccaagaataatttcaaaagaaatgttcctctagtagtacactaaaaacagaacaatggaaaatattgaagcccattttaaccttataaaaatcattgtccttttaatttatgaaattgacttttaaaagttactgagaggaagacagcagggtggctgatgtctgtaaatactgtgcttgataagctcagacaggaatgttgcctcaaattgaagactaacttgggtcacctggtgagttcagtgccaccctgagctagaatgagatactgtctcaaaagaaatcctgaaaggaaccctaagcaaggcactatatggagtcaagtacaacccttttttttttttaattttccatgaatgctcttacatatctaaaagctaccaagtagtatattaaatgcttgatgggttgatggaggatatacaaattttctacttgaaggtataaatatttatgaagaggaaataataggagaacaaacctttaaattttttacatatctattttgatggcatagtcattatacttttttcaaattttttattagatattttcttcatttatatttcaaatgctatcctgaaagtcccctataccctccccctgccctgctccccaacccacccactcctgcttcctggccctggcattcccctgtactggggcatatacttttttaaatgtagttacatattttttcacttatatttaagcaaaaatgtattcagtgaagaagaaaattgtatttggacatgaagaattagttgaaatcctaatgtaaatgagcaaggactttcataataactaagttataagaaaatcaaatgatgactactttctaaatattcttccatataaagcttgtatcttctggcaggatattgggatttaagcaatggttctcctttttaaatgtcaagacttttaaaactttaacaaagatataagaaaatgtttttcggtacaaagcaaaaacgtataaaactgtcataggagatcatctctattgggatcttctctctggcaacaaatacacaatatcttactgagaactgctccaatttgattctggaggatccaaatgggcaattgcccaatatgtacaaaaatctttctttgccatttttcatatttaaaatgtgaccaatactttttgcatttttaaaattaaagaagtaccataaacctaaactgtccaactttgaccataggagctggatgaatgctctagaaatttgtttatttaataatatagataatatatgtatgcgtacatacatacatatacattcatccaggcaagagtttgaaactaggaatattgagagcaggaggaaatgaaacctagtttaagaaatttttcatgtgttttaagagattgctaaaatatctaaggttcatattagtgagcatttaccattaattttaaaagtcagaattaaataccagaacttttagtctatggctttacagtttcatatttctttaaaactatgcagctcatttgtattattaggaaaaataagtcagactggaggtttcaactgatatgtcaaaataactcagaaattttctttcttgttaaaaataatctgatatataattaggcttccagcctaacattttagaatcacttatcccatttttaaaacatatttcttcttaaaggaaaagcaatttgtaaacttttcttcaaggtctctctcacctctttgttatgacagtatgattgtcctgctatgagagataattaactgctagttcattagcatctgcaaagacaagtttcttcattagaagtgaagaagaaaagggcatgatatcatttaattaacatagcatcaattcatagccagatttgatgcacaaactctgtaggtatattctcatcagattcaaattcacctacaattctttctttttcatttgtgtgtatgtttgtgtggattttttgttgcgttttcctttatgttttagaatccttaaggaacatcttggagaacaggaagtttctatttcattaattgttgactccgtggaagaaggtgacctggggaactattcctgttatgttgaaaatggaaacggacgtcggcatgccagtgttctccttcataaacgaggtgagtggaaccttctctgcttgagagaggagatgaatgttccatagaaaggaactcattggaatctagtaaaaggaaattacctgcttaaaattattttctccataaacctagcacaagtaaaataaccccattagcactatgtccatgaagttgttagctgactcatgcccatcaacacactatataaaagccaattatcagaggttaaatctggtagaagaaagccagatttgattaagggttagcacctggctatttgtccctaaatgaacgacattttttagagaactagggtatagaaatagtttttttttggggggggggcaagaaacaacaggaaagaatgttcctttctctgagtggttattgcctggaacaattccctatcctggagtatgtgactcccactcctgaagactgaagttgacctcctataccagtttgtgtattttttaaattaatatgactggcctgagagttaatcctcaaaacaatttccattctttttgtttgctgatgcatagaactggaatttaaaaaaaaaaaaaaaggacacatcttgatttggtctaagggcacccagctgttctgggttttgtaaatctaaaaatcatttagcagttaacatcttcatcatttagatgcaactttctttagaatttagaatggtgggcaatggcaaaccacaaagagacaaccactactacaaaagaagagagtatcatagatagatgaataaatcaaacaagtcaactctgggttctttgccttgcttttatatcaaatatatagcctgaaaaaattgttctcattgtcagtttatgacatgtaaaatggagaaaatatcaattcttcagtgttttataaagataataaaaaataggaagggcttgatacagtcattgtacacagaagatgtttggtgaaatggtatttgaaatagacattaggtcatgaaaataacttcgtttttaatgcaataaagtgtgtcatgattgaacgtttgttccattagttcaagaactgtgtctgatgaattcctcaatatagactttcttgacattttaacctcatatagttttttcatacataatattctcctacaattaatagtaacttactataagtaagacaggttatagttaagtgtaatgtctgaaatagtaactttttctccacagcagctcatcagtttatacacaagtgtgtgtgtttgtgtgtgtgtgtgtgtgtgtgtgtgtgtgtgtgtgtgtgtgtgtgtatgcatgtttgtttatgtgctatatgggttagcatgtttgtgtgtgtgctgtctatgtgttgtgtttgaattgtttaaagttacaaatgattataaaatgtgtgacttggtgaaatttttatgagcattacaggaaaaaatattttttctactttctactaagttaaaacattctagtttacttattccaagtacactttgtactctcttactcagcagatttacactgattttaatttcaaagcacatcttcagtcctagagtctttgaggtttgaaaagaaagagaacactgaaaactgttccctgccttattgggaaatagattctctttgaatagtgttgctgaaagctattaaaatagacaccttgactgtcaaggtgactataatattaaagtagcatattatgctgtactgggaggagagaagcaaaggaagcagcagctagcaacatttcttcctgtactttaacaatagccacacaatgaaggaatttgagtgagaccccgtgtatgtacagaagtacaaaagtagccttagtcgaccttagacttaactacttattctgccaaagactcttcaaaatagcctatcagcttatactggatcacattccaactctagaaaatccattctagctttggaaggacctgttagaaagcatttccacttctctagctttgtatccattgactctagtctatactttcaattgctctttccctagcagtcagatgtttgataatagtcaccatgaccctgctgaaccttcacttcaccatgcactcgtgcttcatttatatgtttcattcctgtaactttcttggatatactctaaattaagagtttagaatagtccttaaatattgaactagtaaagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatatatatatatatgtgtgtgtgtgtatatatatatatatatacaaaaatactcataaacacaaaataaaataaatctaaaaagaattttaaatttattagtttggataaaatatatttgcatgtggagtaaggcagagatgacagtgaagggattattataaagaagtagggttgacaatgtactggatatatgggggaagtgaatagagctgtacttttaaggcaggtatgcatttagtacggataaaaaacactctaggatacttctagcatgtttagcctaaggttaaacatacaaagacactaaagattccaattaaagaaaagtaaagttttgaaaaatcaaggaaatttttgaataataaatgccattaatgactgattgattatctgaatataaggaagacaaatatggccaattttggttgctctcaaatacttaactttcccatgatactcttccaaatttgtatttatatcaacaacagtttgttcttattaagataaaagcattaattccaaaagagtcctttgagtttgtatactctgaaagtctgttctttttttattagatattttcttcattcacttttcaaatgctatcccaaaagtcccctataccctcctcttgccctgctcccttacccactcactccaactttttggccctggcgttcccctgtactggggcatataaagtttgcatgaccaatgggcctctctttccagtgatggccagctaggccatcttctgatacatatgcagctagagacacgagctctgggggtactggttagttcatattgttgttccacctatagggttgcagaccccttcggctccttgggtactttctctagctcctccattgagggccgtgtgttccatcctatagatgactatgagcatccacttctatatttgccaggcactggaataacctcagtggtgcaccttctttgcaagagagttggagcaaaggagtcttcccttgcaaaggcaataatggatataatcttctctcaaagggctcattctatggaatgaccaaacccttcttgaaaacaaggaaattggtcagcataggacataattgtaacttcactaccatgacaaagttcaaaaagagagaacatagcaagtatgatcccgtaggtttgaatcttcaatgataaagtctctgaaagtatcagacttctgtcacagtatcaattatgcagttataaaatttttttctacatttctcagaggaccaatgctctatatatacacacacacacacacacacacatatacatatatatgtatatatatatatatatatatatatatatatatatatataaaactaaagtttcagctccaaactttgtctctgtaactccttccatgggtgttttgttcccaaatctaagaaggggcaaagtgtccacaacattatgaactaaccagtaccccggagctcgtgtctctagctgcatatgtaccaaaagatggcctagtcggtcatcactggaaagagaggcccattggacttgcaaactttatatgccccagtacagggtaacgccagggccaaaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagagagagagagagagagagagagagagagagagagtgagagagagagagagagagagagagagagaatgagaaaatgaaggggaataaagtcctgtttgtctatgagtgccctgactctttttcctaactccagtaagctgcctattttcacttaactttgctagtgtctggcctggaaagcttgagagttaaaagttaaatgccggattcaaaaagagccaaacagtttttcatctaaggacagaaccttgtgaaattttccctggcattttcattatatagagtttgtttaggaaagcatatttttgaaatatttttgaggtgcaagtttgttgtcatgtctagaagatactatcaagctcgctctctttctctctctctctctctctctctctctctctctctctctctctctctctgtgtgtgtgtgtgtgtgtgtgtgtgtgtgtgtgtgtaacaataataattaaagaagatatcatgaatttgagagggaaaggtgggaatgtggaagaagttggaaggtgtaaagggagagtagaaattttgcaaagttagtattcatgaatgaaattttcaattaaaaaaataaatgaaaaagaacaacagtaaaggtttacatgtcagttactgggttgtttctttttcctacacatagttgattaaattttgtatctgagtctatgaatatttatttacctagattcctttgcttgagtatctagttgctgttgcctatcttgacatgcaccaattttccttgaaaccctaacctttcttcttctctccattttgtatgttttcaatttctctaataaaaagatcactctagaatagtgcttctcaaccttcttaatgctgtgatcctttaatacagttctcatgttgtggtgaattctgtgtcagtgacctatgatttctggtcccaaattttatgactaccccatgccctcacgatatgggcatctttatagtctataacacagcactttggtagttaaggcatgggactgagaacaaagctgtctgtgttcaaggctcaactcttctttataactgttctgtcttagataagccactccatttctgttagcctcaaattgtcttctataaaatgggactgctaagtgacctaccacttatagcaacgtgagatttatgaacatacctgccaatgcttatcacagcatctgacatatatttagcacccaataaatattaacaagcaactgcaagatttctctgcttcaactctgtactatgagggtaatgaaggatgcagcaattgtgtgttccattaaaatttctatgtattctaatttatctttcattaaaatgatcatccttagctccaacaactatgtctcattcatctggattttatcttacaataaatttactttaatttttgaatgcattgtcctgaagaatttcattcatttattcatacatttaatgataattattaagaatcttctatgtgcctaacagtgtgttcacttgcaaaattaaataaagagggagaataagaaccaatattaattggaatgtcatgatctccattttaaattacactgccaccaaacattcttaaaacagaattgtgctttgtgtgtgtgaatgtttgactttagaattgcctcattaagagttttcagtaataatgttggtctgaatgataacgtttccttatcctgattacaataatatgtcaattcattcatcataaggtagtagaaccagcaaagtatctattggggagacttggtgctagttaacaatgataaacatctagcttttctctatttcccctcaaagccatttcactttttctgtgcactttgtctctctccaaagaatgtaatcaatagaaattaaacttgctcaataaactccctagtcctggaaatatctccagtaaagaaattaatgtgaaaataatttaggatgcattgttttaaagcagatgcctttggatccagtgacttgtttgccccttcttgtaatggatcatctttgtaatgtgttgccatgtccttgtttttatttgcctagcacagttatttcctgagagattcagtatgataatggaaccttttaaacctctctttgagatttaagaagagccatttggtttcattgagcactgatattagaatattttgaaagccaaatcctgctgtgacatcatagtatcccagtgcttgatggggcactgtctccatagaagggtcactcttaatgagtcttgcaatttgcaatgccaatgtatttaggagtttaagttgtgtttttgcagaatcttcaactcatagttagcatttttaaaagcctttttccttatataagatttaacatttcttcatcaaattgttcttctctcttataccatagatttttgcccctctgaccctctcttttgtagtaacactaagtatttgtttccaactccatatttttttttaattgctaatgtcaaaacagataaaatctggttggagtgatggctctgtgtttaaaagcatatactgttcttccagaggatatgagtctgattcctagtacccatgtcaggtaactcacaaccaccagtagctctagctccagggaacctgcagttgctgacctctttaaacatcttcatccatgtgcatatcccccacccacatatgcatacatacataattaaaaagtannnnnnnnnnnnnnnnnnnnaaataagtctttttaaaaaataaataaaatcactttgaggctcatttgatgctaataatctttttacctctgttctttttttttttaattgggtatttattacatttacatttccaatgctatcccaaaagtcccccacacgcttccccacccactcccctacccacccacacccctaaccacccagtcccacttcttggccctggtgttcccctgtactgaggcatataaagtttgaacgaccaatgggcctccctttcactgatggccgactaggccatcagctgattcatatgcagctagagacacgagttccaggggggtattggttagttcatattgttgttccacctataggattgcagatccctccagctccttgggtactttctctagctcctccattgggggccctgtgatccattcaatagctgactgtaagcaaccacttctgtgtttgccagaccccggcatagtctcacaagagacagccatatctgggtactttcagcaaaatcttgctagtgtatgcaatggtgtcagcatttggaagctaattatgggatggatccctggatatggcagtctctagatggtccatcctttcatctcagctccaaactttgtaactccttccatggttgttttgttcccagttctaagaaaaggcaatgtgtccacactttgatcctcgttcttcttgagtttcatgcgtttagcaaattgtatcttatatcctgggtattctgaatttctgggctaatatccacttatcagtgagtacatattgtgtgagttcttttgtgattgagttacctcactcaggatgatgctctccaggtccatccatttgcctaggaatttcataaattcattctttttgatagctgagtagtactccattgtgtaaatgtaccacattttctgtatccattcccctgttgagtggcatctgggttctttccagcttctggctattataaataaggctgctatgaacatagtggagcatgtgtccttcttaccggttggaacatcctctggatatatgcccaggagaggtattgcaggatcctccagtagtactatgtccaattttttgaggaaccaccagactgatttccagagtagttgtacaagcttgcaatcccaccaacaatggaggaatgttcctctttctccatatcctcgccagcatctgctgtcacctgaatttttgatcttagccattctaactggtgtgaggtggaatctcaaggttgttttgatttgcatttccctgatgattaaggatgttgaacattttttcaggtgcttctcagccattcggtattcctcaggtgagaattctttgtttagctctgagccccattttttaatggggttatttgattttctggagtccaccttcttgagttctttatatatattggatattagtcccctatctgatttaggataggtaaagatcctttcccaatctgttggtggcctttttgtcttattgacggtgtctttaataaaggacatttcaaggaagccaccaaacttagaggcataaaaactaaccttttaagatggctagttcacttacacagaatatataaattatgtgagaataagcctaggtaatttttgtttgattaccttgttcaaacaaaaccaatatgggaaacagagattgataaacttctgttttgagccatccctgttgatcatgaatatgaacggaaactataaaatagttcattatatatgctcatatttatcatttcttgttttttttttctactaaaatgttaaatacttgataaggtacatttacttttctgtcatatgtttcaatgtgccctacttaataaatgtgatgaatgtgtcctatcaaacaggttgattaaatgtatcctgaatcatctacattttacctattgcagcttctcaattttgttgctattgatattttgggctgaataaatttctcctctggtaagaactgtcttgtatactatagattatttagcagcatcttatgcccttacctacattaccttttgtagcaatggaaaatgaaaatgtatactgacattataaaatatccccagagaacaaaatttatcccaaaataggaactattggtttacagtatgaatagagaaacccacttacaagaaatggctttagcatcttaagtactcatagcagagaatttcaaagtaaaagaactggcattttcactgtgaaaaccctcaaagatcatatcaaatggaattggaaagaacagaaaatcaacagaacaagaatttatatacaggaattgacagcagtcagactatttgtttctgtatttggaaagccatctagatgtccctattcctgtacttcatacaatttataatactcataaatcacctaggagcttattagaaaagcaattcagatgcattagtctgaggtggtatgcaagacttgaatttcaaggaaattcattatagatatgattgctacttgtctacagaccacaattggcatgccatgccttagctacacaatagatcccattaatgcacttggaatgatctaagttcaagagtaactagctttctggagtttagtgtgtctatgagaaagaaatgaagccagagaacaaccaatcagtgggactaaatccaagtaattgcctcattccttctgcagagtcaacacctttgccctaacactctgttcttaatgaggttactaacatcacatattcaatgacattttgccttctagaatgtatttattactcaagagatgccggagaaggcactctcttcaagtattaaaatgatcaaccccttaaataaaaaggccctcatttttagaaacagttcctacatttccaatgctttaataggaaaatatattcagaaatctctcaacaacatatattttatattacctataaaacaggttgtctatagtgttcagtctgtacaaatcataattactgagtatatgtaatacccatgatatataataattagtgaatactgctaatttcctctttcaaatgttgaattcaactaaatcataactctgtatagtaggaggggtggacatagtatcagaatcaaaacaccacatattgttggtcatgaaaaggagaaaaaaaaaaaagaaaccataataggacaagcaacaggacaaagtgtttctacatgttcaaaagtttaatccatttgcattaatatctgcctagcatttcacagagcagctataaaattcaaataaacctcaagtaagggcaagaaaatctactgaaactcagagttttgtattagaaaacagtaagtatgccacttaggaaaataaatacatcagttaaaaaacacttgaaagggggctgaagtgatggcttagcagttcaaaatacttatcaaaagaaccagactttagttcataatactcttgtcaagtggcccacaactacctgtaactccttttacagggtataagacacctaatcccaattctaagaaggggcaaagtgtccaattctaagaaggggacaaaacaggagttacagagacaaagtttggagctgagacgaaagtatggaccatctagagactgccatacctggggatccatcccgtaatcagcctccaaacactgacaccattgcatacactagcaagattttgctgaaaggtcccagatatagctgtctcttgtgaggctatgccggggcctagcaaacacagaagtggatgctcacagtcagctattgaatggatcacagggcccccaatggaggagctagagaaagtacccaaggagctaaagggatctgcaaccctataggtggaacaacaatatgaactaaccagtacccctcagagctcatgtctctagctgcatatgtatcagaagatggcctagttggccatcagtggaaagagaggcccattggtcgtataaactttatctgcctcagtacaggggaaggacagggccaagaagtgggagtgggagggtatgggggacttttgggataacattgaaatgtaaatgaagaaaatacctaataaaaataaatttaaaaaaagacacctactccttgcttcttccatgggcacctgcactcatatgcacaaactcacacacacacacacacacacacacacacacacacacacacacctatacacacataaataaaaactagatatttaaaaaagaaaataaattacttgacggacacacaccaaaaacatgtaattcacatacacacactgattagctatttctctgccaagtaaaatgagccaactcaagaaagattaaattatataactggcggtttattgggacactgctctcaggtgggtgagttcactggtcccaaggaaggaggccagggaatttgccataggaagggagacagaggggtgaggcagtggggagagaaagagagaatgagctcatgcagagagaaggaaaacaggggagggtggtccaaaatgtctggttgtacagggaagagcctctgggggcaggacagcccagccccagggctggaaaattcagggttaggggtaggatatgccaggtagggactgggggatgctggtagcacctggaggccaggtctgctttgctatgtaaaatatgcacctcaactgtttgttctggcatctgaagccaaacatgttccacaactacaacataatacatggagtcagagatagtagacagaatagtgtgtccatgaccaatacccaccaataacccctttctcctcctcctcagaatcacctttgtattctcattatttgcaatcaaatttacctacttattgttgatgcttcatatcccatttgaaatattacttcactacaagaggcttagaggagaaggcttatctaatgctgtggagtgaaaataattccacttgtaaaatatgtaaataaacatacatatttaccagttttgggttaagcacctatatgaattatatgtggtaattaagtcactgctttcagagggatgtagaccattatcctagggcaacattgttggagagaggatgctaagtctgcacttgtatggctaggaattcctacatttgtttgagaaatggcacaactgggtcataatacaatacaaaagatataacttttaataagcagttcctggatgtcgaagtttgacaaccaggtcagtacctgagaaatttgacatgacacataaaaaactgctaactgcactctcaggtcacatagcaggaaaaagtatgttgatttccaatagattaccatggttacttgtgttagatttttagtgctgagaaatacatttgccatctgtaagagacatgttagctatttgtctctacttttagagtacgtgttctattttcagagtgtgctcaataaagagtaatatacatggaggttgagttttctaaattaaaagtgggcatttaaatgtcataaaatgaattaaaaataaattcaagaaaattccagcagtatatttaggaaggcacccaatgatcatttttaaaccacctaagaattattaagttaactctgatatgactgaaaagaaattatgagctatgatgcagaaattgagtttcttgagagtcttttaattttcactcttcagttgcttgttacctagagcaaatctctgcctcattgttcttcagtattatcttttgtaaactaattgtccttcagcttcagggtagaaatcttgaagaacatattaagtactcacaataatatatattaggccatatttcagattctcagaattttgtgcctcattttggccaaacctgaaagttaattgaagtgcttgctcttcccaacagattttcttctggtttagtattaagttgcctcagcaatttgctcccattagtgcaaaatacaaactacagctccttatatttcactgtagttctgattactgacttaccattgctgcctaatccacacaaacttaagtgtatcccataattagcctcaaaacaatgacaccattgcatacactagcaagattttgctgaaaggaccctgatatagctgtctcttgtgagactaggccggggcctagcaaacacataagtagatgctcacagtcagctattggatggagcacagggcccccaatggaggagctagagaaagtatccaaggagctaaagagatctgcaaccctgtaggtgcaacaacattatgaactaaccagtacccccagagctcttgactctagctgcataagtatcaaaagatggcctagtcggccatcactggaaagagaggcccattggacatgcaaactttatatgccccagtacaggggaatgccagggccaaaaaatgggaatgggtgggtagggaagtggggttgggtgggtatgggggacttttgggatagcattctaaatgtaattgaggaaaatatgtaataataaaaaatattaaaaaaaaaagaaagcaagcccagtatggtagttcatgcctataaaactagggtttgggagactcagtgctgaactgcattaagtctgaggcttggttcatatagagtttgatgcccacctgtgctacagaatgagaccctgtatcagaaagaaaataataacccttcaacaagtgaaccttatattacccaacttaaatgaatttgaaaattctggaatgtaatgtaaaatgattcctacagaggaggaataatcatagattttgctatttcttgtccccccaagactgctcattacatcatagattttttttaagttcaataaaatattagcaaatttagaaacaatgcaaaatttctaccatgttccccaaatactttctgtattcaataacaaagagtgatgaaaagcattcaaacgtgagaaagaaaagagctttctgttactcccatttgagaaataagccagcatgcagtgtgattgctgttttggccctaataatctctaatgctgaaaacaccaagaatttcaaatgaaacttttctcaagagggaaaatattaccaatggctttcaccaaaaacagttgtttctaaagctttcaataattagaaatatattaaacccttaaagaaagcaaattaaaataatagcaaaagtctgacatttatcagtgctttccattttgtaaccttcagtacaattaagttttatatgtgtgcagtttttataaatttatttccataagtagaatattcttcaaatcctatttaaaaaaataagagtttaatgcatttgtcaaaaagtagaatacattgctcttactggttatctaagtagtccagatgttctgtgttctttgggcatcccaaagcattcccaatggaagaactagtagttctaactgtgacaatatatcctctggtggacaattgctttcaggataaacatcacattctttaacaaaaaggagtggaatggcaaagccaccttcactttgacagttttctctcaagagaggttttgtaacattccatctgtgcctgtctgtttgtatgacatgttaagaaggaaattcctagtagagagaaaacaaatactttttcttctaaggtattttcttttaggcatcagtgaagtctgacgccttgatatacactagccatgtcttctcagctggtcacccgaggcccttttgttctttattttagcagtgtcctcattctttgtctggtttctctttcgagatctaagatgaaagagcccacacttaatcttttatatgtctatatgtgtgtgcaaatatgtgatgtgtatgtcccttgtatagtttctatagagtgatatttcaaatactggtttacggtttaaaagggaaaaaaataaatctgcattagacctttccttacgcttggaactccgcattgtaccttttgaaatcgaatgccaacgtttcccaaggggaatcatagtgtgattgttctgacctaattttaggaaactagcttaactggtaccaggcataaatccccaacaaatattgttttttttggaaaggcacaggttatttactctgaaagtaaattaagaagataagtaaaatatattaactaaacaaaaaagcagaatttgcctataatcattgaacatccaaaaaatatatttttcatttaatgctgtgtcaaataatttttcacaaacctttgcaggtacttttgtactatgccattcagtggttgatttttacctttacaaccccaccacaacccacccaaacacatacgcaaatataccaagcatcttgcttacttgtcttgtgattatgatacttttaatatttttatactcataaaagtgctagaacagcgatacttcagtcctcaacaaatattggcatgtattttatattaactacatgcctacatgtcagaatctttaagaaataaggcaataatcatatatctctttccttcactttatcacaagagtcaaaaccattgaaccactatatagaaaatacttattaaacaaagataaaaaatgaatgaatgaatgaaaaaattaaatgggagaggtatatctcagtggcagaggactcacttagcatctgtaaggtcttaatgaaatattaggtgattctcattttctaagtgaatataaacttttaaaattctatgcattgatacaagattatattatcaccataatcatgaatgaaagatgacttttaaatctatatgacctaaagttcatttccatttctgtatctctctctctctctctctctctgtatgtgtgtctgtgtgtgtgtctctgtgtgtgtatgtatttatacatcttcagctgctggaaaactacgatccattgaactaacactccacacacagttaagagaaattatcaggcctcctgttttttatctttgcattactatgtgactgtgaatggtactgcccttgcaaatgccattttccttttgaaatggaccctgcttttcagctctaatcaaagttgccagcagaggcagtatttaaacaaacaaacaaacaaacaaacaaaaaaagattccatcccagcacaactaagcttctgagaaaggaaagagagaacccagactttcaaaaacaaaaacaaacacaaaaataaattctttggttaaaatgatagattctgccccctttaaggggtggaggctgaatattgaaaattgtagaagcaaagctgctcaacaaaaacctaagggaaactgccatttgcttaaacacaactaatgaacgagtgccagagacttacatttaagggcaccgacagtcatttagttacaggcaattaacaatagtccttggaaagcgccagtacagtcttagggaaaacacattgattattgctgcagtagtagactgctttctgaataaattgcttcaatttaaaactagatttgctacaagcattttgagcaatgactacaattttttttcttatcaagacagttggtgcaagcaaccctttaaaagaaatggctaattaaaataaagcacatgccatctattggtatattggattacattgcaaataataaatgtacttggtttgcactaatcttgctgcaattacctagtgtagtttgggatcctatatatatatatatttattgacctgtacctgggattagtgtttgtgtactctttttctagaaatctttaaagaagtaaaaattttacaaaataaaagttcgtgtgattttttttttagctcaattgtctgaattttcattttgtatctctgatctcttttcatacccatatagatgcataaatcttgttgacagtgtaatggaagactttgtgtggcttacttttagtagttcattctaaaactgttctgttcttatataaaattgttcggcatgatcttcccttatttataatgcggtaaatgcaagtcagttgtggaaatacatgatagacaccataatgatcctagtttattcattagcttcaccacatactttttctacgattgtgttatgaagatcttggtttacaaggatttatccatccacgtaaattcatatgcatatttatttctctgaagcagtataaactatttgttcctggcaggaggataattatgttcagcttacatagatattcaactcaatttctatgatacatcagcacaatttagaagcagttacacttttgtggggcaggggaataatacattaagaagctgaattgttacttgtatatagaaagaatatatatgtatatagaaagaatatatatgtatatgaatataagcatatattataggaatataagcatatatcactatgtaaggagaacatttttaaatctttaggggggagaaacaataatatgtaaaattcccataactaagactgtactggcgctttccaaggactattgttaattgcctgtaactaaatgactgtcgttgcccttaaatgtaagtctctggcactcgttcattagttgtgtttaagcaaatggcagtttcccttaggttttttgttgagcagctttgcttctacaattttcaatattcagcctccaccccttaaagggggcagaatctatcattttaaccaaagaatttatttttgtgtttgtttttgtttttgaacgtctgggttctctctttcctttctcagaagcttagttgttgtgggatggaatctttttttgtttgtttgtttgtttgtttgtttgtttaaatactgcctctgctggcaactttgattagagctgaaaagcagggtccatttcaaaaggaaaatggcatttgcaagggcagtaccattcacagtcacatagtaatgcaaagataaaaaacaggaggcctgataatttctcttaactgtggcaaaataaccacttctgattttgttctgatgtcatgggtaagccagaaaagaaatagggctcatattcactaagtgtccacttgatgcaggagtgtacagactaaatttaatgcaccattttccttgggagcattttcacaatgtgataaatttacatcaacttcataaatactagtctgtgtacatttacagtagatatgcctatatcagataacacaacaaagagcagcactggtgtgtgccttgaaagagaagaataagttctgttcccgacctccttgtaaggatgctggaagaataccatgtttgtacttgtatcactgcagtgcatctgataagaaatctgagataagtttaaggttttggataaaggagtaccttgaaattcttcatttctttcgataagttttcaaatgctcttattaatagtaaatggctgcccctcaagagagttattcttgttcattattcgggctttaagtatatgttgctattcatatgtttgagatttaaaactgttcacatggcacacaatcatatatacaattgcaaagctacatcaacccaattctttcttttattaaaattacttttcagataatactatcgattatgtaaatatactgaacatttaatgtatttggtgcaattttgaaggctcatgcttcgataaaaagaaataaaccatattttctctagaaataaaaataacttactgaagtacaacttttcctgtaatttattcatattcaatttctgaaaaagaatgtctgtgaatttaaaagaaaggaaagaggggtatatgggatgctttgtagggaggaaaggaaagagacaaatataattatattataacctcaaaaataaaagaaccagttaaaaaaaagaaccaagaaataaacatcagtttgcacatatgcagaaacctatattatgaacaccatctaaagaaaatcagggttttttttaattgctatattactaggaacatggttctggcatcatttttattgtctctaaagctatttgactctgtatggtactcatactatgttacaatcttggacctagtgctatgcctccagctcttggaagcactatagaaaaagcattccctgcttggctagttatctacagcagaacagctgttctctctccaatatttccttagagcatctcctcacacaggccttgggtcagaacttgtaacagcttttcataagcaatcacaattttaaagaattgaattatgattggcataagataaaattcatagacctcaagtgatcatatcaataaattttaacaaatgcctacatttaggtatctacccccaagacaagataaaatatattcctgtgccctataaagtccttcctttcccctttccaataaactttcccttcacttattctgtaagaaatatatattttctaggttatatcactgcactatagtatgatgttcttgtacttttgtagaatcacatggtaaatattactttgcatttggcttccttcactgactgtaaccctatgagtttttcatggtctttatttttagtttcttcttttggttgctgagtagaatctatttatgggcaaacattagcttatccagcatctcctgttaaaggaattttgggttgtttccagtcattgttagtatggataagactacttcaaacatttttgcataagactccctgccagtgtctgtttatgtatattagagaactacatacgagtacaattgatattgacattgatttttcactttactagaaaactttcccaatgtaacagcacaattatgttctctcatccatcatcaatgtttaacataccaattatgtttgatcaatttcctttatttcttttgcaagaaattttatttttgtaaattaaacaaatgtcttactttagggtttctattactgtgatgaaacacctgaatcacagttatagagggaagtcagagcaggaactcaatcaaggcagggacatgggggcaggaactgatgcagaggccataaagaagggttgcttactgacttgattcccattgtttgctcatcccactttcatatagtatccaagaccaccaacctaggagtgacaccacctgcaaggagatgaggcctttcacatcaatcactaattaataaaatgaccttcagacttgcctacaaccagattttacaaaggaaatgtctcagttgaggctcactcctctccaatgacattagtttgtgttgtctagttaacataaaacaagccagcacaaatcataaataaaagaacagaacctagggaaaaaaaagggcacgatgtgggctatatatgtgcttccatagtcgagccttcctctagcgtgaggttctgtgtttggtcccttggacgacacaagtggttgtaatctaaagtatcatctctccaataatgtccagtatattttaaatcaggatgttttggtatctgaatcatcttatgggcataagttgtactttcattcaggtttctttgtgtggtggaattcaattgctattcctagagaacaaaacacagagttctccacagtattatttacccaagtattctttttgttcacacaggaagaatgaaacactatcgtgaaggacattttgcatttttttccttacacttttttagctctctcttgtgtggtcccttacagtatttaacagataaagctagtgtaattattttccattatttcatatttcatgctaatttactttgactcagaaatatttaatttattttacctttttctatcttaaagtcatagtcagaacttcttaaataaatctttaaccccccgtttaattttactaagtataaaaagtgcagttgattaaatagtagttatatgtacttactttattaaacacattagtaataaaagaactagatgagaaacatgactgagattatttttcttaattgttagaggaaaacttttatcacatataaacacacacacacaaactctctctcttgtgcacaaacacacacacacacacttgcatgttgttgtgagcaaatgaggaccaagttatttccttggcagtacctcattcccattattttaccctatttatgagaatttaggagtgaaattgttacccaatagtatgtatttttgcaagtcattaattattttactgttttcaactaagcttttattgattgtgctgtaagtgatacaactccattccttcatagtttcccaattacagaatctaaaacaacactagatttgttttttaagtaaataactgcgtgttctgtgagactattcttcaagaaatttgagcagtctactcaccccaggtagggaactgagagtagaccaaaataaggataccaccaaagaccagtttggtgaaccaatacattttattagtgttttattgtagttattggcaaaaaaagactcaaatgacagcagccttagcaaatcccactccagtgtgggtaataatagctaatgaaagctgaaaacctaaaccacacttcacagcctgcaggctgcataacaaactggaaagtgtccttccccagtgactaaaccttatccaggtaccttggctggtttctacttcttccagacagctgatctcgtctcagagtctttgtagcttgtcttgtctaagagtgattctcagcattccttattactttggtcaggagacatctaatgaatctggttattgttgttaactttctgagcttaaggaggtgaagttctacttctctgaaacatcttgttgcttcaactcccttttagcattctatatgttaatgagctccttttcaagacagaagagacaaaactgttaaacacaacaccttgcttaatcaattaaactactacttttcagcttaatgtcagggaacaacagctacctataagtaatattgtttagcctatgatgatcaatgacaacatgcatacacaggcatttaggaagagtgagtttcagtgtgtgtatatgtttccttactatttgcatactagcaacttaactctccttacaatcttgataagctctaaagaagaaaatgtaagtgactattttaccccattttttttggtccaatcatttttgttagaatatcaacattctgcatgctaaaggagaacttgcatgcagcaaatgtcaagaaaattcctcatttagacatctctatagtaacatacattgcataatataagggaaagtaaagaaaaaggtagtatcttaataataaaagtttacaactcattttattgtgatatccacttggagacctacgttttaaatctacttaagctctcagccttgaagattatgttaatatacaaggacactgctcttcagagaaatatacatccaaaatcatgccatcttgtgagagaggacagacagcattcagtgggtagttgaacagtgtatgtgctctctaggaactattctatttagctcccttattttaccttgaacccaactcataggtaacaactcaggtaacaatgatcaaaaagcatatgcagatgatcataaagctgtcctgtcttaaaaaaattgtctcttttatcaattctaaaagcatagttcacaggaccttctcaagggatatatgatatgtgcatgtaaaagttgctgctttgaggcaaacctaatattatagtttgaaatgagacatttacaatattttagttcagaggcaatgtgtcaaccaagttcttttttaccaaagcagtgttactaagcaacattgtcacatatcaccttatccaatcacccaggaaacagagttcaaagctaaagctggtttaaagcctcacacaagatgaatacgtttgtacacacccatgaacccagaacttgagaggctgaggcagatgtatcacaagttcaaggccagcctaggatacccaatgagacctaacatcaaaaacaaaacaaactaatttgtcacagaaagagggatgaggttgttttaatgtgtctgaagtcacttgcaaaaacatgaaaacaaaatcattctgctttttatgtgtgattattgtataattctcctttgctttcatgccctagagttaatgtacaccgttgaacttgctggagggcttggcgctattctcttgctgctcatctgttcggtgaccatatataaatgttacaagatagaaatcatgctcttctacaggaatcattttggagctgaggaactggatggaggtaggatgacttccctgtgttattgttgcttctgaatatacttatttgtgtcctgcctttatttaatccaaaaaaggaaagttatgtgcttctttgtaagatcatttttgtatggaaatatgtgtggcgatttagaagcaataggtagttttcttggcaagttacacctaccctttttagacttgtattccaaagggcacttacaaattacagatgctgattgcaatgccatcggcatgttccttctctctcaccttgtaatcagcacagaaaggccagctacacttttctataggtaaggtatttctcttttaattgtcttccctagttgagcagtttgaagtgaatttcaatttgttcttgtttacacagatagctgttttattaacttgtactgactattttagcattcttccaagaggctcttcagtctagtccatctctctatttttagatgctaggctcctgtctgtcattccaagggtagaccaaaggaaaaaagtacaaactcacattttttttataataacacatctaacacctttgctcatatagaacaagtaaactgtgttttatagaaacagtaattatcatttgcctcaagccatccaagaatatctgtgcattctaaaaagaatctagggttcataaaattgacctccctacaccatccattagtgaacttcaaggtattttgtgttcctttggggtcacttggaaaatgtaagttaaccttgcaaaacacatagagcttgaaaagtgtcaagagttagtgaaaattattgcagtttctcaattctgttgataagcatttcactttgtcaggtttacatttaatagtgcaaaagaaaatgaaactttgtccctgtttccatgggtctatagccagagctatcagttgtcaaatgtgtgaaaaggagtggtttattggtattgtccaacatcctctccatttacgcttttcctgttgccactaaggtaaaggacgggctgcagaaacattatttttcatggagttttctttattattattaaattattttatttatttacattccaaatgttgacccccttcctggtcccccctcccagagttatttacccctcccctttgcctctgagagggtgtgaccccacctcctctacccacctcctcccccagctgtccccccagcatcccccttccctggggcatcaagtctctacaggattaggcacatcctctcccactgaggccagacaaggcagcccctctgctacatacttagctggggccatggaccagcccatgtatgctctttggttggtggctaagtctctgggagctctgaggggtttgggttagttgacattgttgttcttcctatggggttgccatccccattcagtcccttcagtccttcccctaactctttcaatggggtccctgacctcaggccaatggttggctggctaggctataagtatctgcatcggtctcagtcggctgctggtagatagagcttctcagaggagagcaatgctaggctcctgcctgcaagcaacagttttcttaaagtgattattattcttagttgttctttgttttccattttcttccctgttcataaaaattagtgtattttggttatttcaagaatatataagaaaactgtcaatgttagaacgactgttggatgagagcaacaatctgcatgctgtacaacctaaaattattactaccaaacatcaaaaaagttacaagtttagtattataatctacatttcattaataaggcaactgagccaaaagttaaataatccttatatctgtatagaatttctaattttcaaggatttatattttatatgaaacttatatagcagatttgattaatcccagaaaccttgaattacttctcaataaactactttgtgataaaatacattaatttaaaataataaatgcataaataagcaaaagttaaatatttattcaaaatgataactcaagtattgctgtaaatggccaattatggatataaacaaagtctatttccaaatcttttatattctgttaccaagtcttcattatttttaaaatttaatatactcaacattatctgaatactgctgttatttgtgcaattataagtagatgctatttgaaaaagcagtttatctaaacaatctcacattatctattaaccttgccttaaatatctctattttgttctgaatgatatgaatgattttacccaagcaatcaatttccagttcaggcttcatctgtcattttctgaatatagaaaatgacagaatttgattttaaaaaagcagaaccataatcagttgagtttcggtaattttaaatttgttgtgaggaaccttgctacctatgcacacttgagtgggttacttgtataagcctaatggatttcattgctattctgaagctatttgggacctcatttttttttgcattgttttaggtgagaagacaaagcagagaaacagaaagaaacaataatttaacaagttaaattttccctcaaaaagctaatttagtttataaatgccttaggatttgttaaagcctgtccttgaggctatcttgagcataatcaggtatataagtgctagggctttctttgagatgctcctgtgaatgtaataagcctaaagaaagccaaagtaatgaactcaattatcatctgggtaagatgaatgtacgcataatattgctaaagagaaaaagaaagcaaagactgttaaggcagagagcactgaaatggttgtatgagttcattctgcaaatgcagtgagcctcctggaattacaacagaactgttcctgctgagatggggcctaagaacccatccttaagtaatccgccttcccagagtggacctgacttgtaccacttctagaaacatcgttttataggacaccttttccagtaatattaagaatgtaacaagtttggtgctagatagatggttcagtggtctggagtactggctgttcttacagagtacctagcttgagttcccagcactagcatggtggcttcttgagaccaaaaggacataaatccttacactcactgattctgcctcaaaacacaggttcttccattccttctgctccctgaggcccagaaaccctgatgcccatcctcttctcagaaacccatacaattgcctaatcttagagacattctttcatttaatttcattcattcattcattcattcattcatttagtatatgtaactacctttggaagagcagtcagtgctcttaaccactgagccatctcaccaacccccattctttcatttcttaaataattaataatctagaagtagaaaacaccttggaaaatatcaattccctatttgttagctccccaccatgatttgcctcctccaaaggaaatgattggcaagagaaatgcctggtctttcaaaagactttgacttttaaatatgtgtaattccataatcaaaggtgaagccatttcttttttttattggatattttatttgtttacatttcaaatgttatcccctttccaggttgcccctctgcaaacctcctatcccatcctctcttactctgcttctatgaaggtgatcccccacctaacttatgccctagcattcctctacactggggcatcaagccttggcaggaccaagggcctcccctctcactgatgcctgataaggccccttcagctccttcagtccttcccctaactcctccattgagatccctgtgctcagtcccatagttggctgtgagcatctgcatctgtattggtcagggtctgacacagcctctcaggaaacagctgtaccaggctcctgtcagcaagcacttcttggcatcagcaaaagtgtctgggtgtggtgtctgcatgtgggatagatccccaggtggggcagtctctggacagcctttcctttagtctatgttccactctttgtccctgtatttactttagaaaggagcaattctgggttaaaattttggagatgggtgggtggccacatccctcaaccccaggggccatggctaacatctggatattttctcaacaggttctctctcccctttgtggggtatttcagctaatgtcaaccccatggggtcctgggaggctctccctattctggcatctgggacattctggttgctacccccagttccccaacccccattgcttcacacctctgttcaatgtcctaatcctctgtacatctcctccatctcctcccatacctgattctgcccctctttttctcctccccatcccctcttccccccaaatccctcccaccctctacttcccttgattatattgttcccccttctaagtaggactgaagcatccacgctttggtcttccttcctcttgagcttcatgtggtccatgagatgtactgtgggcattacccactctttgcctaatatccacttatcagtgagtgcataccatgtgtgttcttttgggactgagttgccctactcaggatgatattttctagatccatccatttgcctgtgaatttcatgtttttaatagcggagtagtaccccattgtgtaaacataccacattttccgtttctcttttgaggaacacctaggttgtttccagattctgactattataaaaatggctgctatgaacacagtggagcatgtgtccttattacaggttggagcatcttctgggtatattcccaggagtggtattgctggatcttctgggagaactatgtccagttttctgaggaaccgccagactggttttcatagtggttgtaccagcttgcaatcccaccagcaatggaggagtgttcctctttctccacattcttgccagcatctgctgtcacctgagtttttgatcttagccattctgactggtgtgaggtggaatctcagggttgttttgatttgcatttccctgatgactgaagatgttgaacatttctttaggtgcttctcagccatttggcattcctcagttgagaattctctgtttagctctattccccatttttttttttgataagaatatttggttctctggagtcaaacttcttgtgttctttatatatattggatattagccctctattggatgtagcattggtaaagatcttttcccaatttgttggttgccattttgtcttattgacagtgtcctttgctttacaaaagcttttcaattttatgaggtcccatttgtcaattcttgatctttagagcgtaggccattgttgttctgctcaggaaaatttcccctgtgcccatatgtttaagcctcttccccactttctcttctattagattcactgtatctggttttatatggaagtcattgatctacttggatgtgagctttgtagattgagatgagaatggataaatttgcattctcctacatgctgacctccagttgaaccagaacaatttgttgaaagtgttgtcttttggtttttttgttgttgttgttgtttgtttgtttgtttttttctattttatccttagccattttatcagtatatttattctaaaaaaggaaacttaaagattagctgctagtgagtggtacatagctcaaggttagaacacatgtctagcatacataaggtaccgggttccatcttaatcactgaaggaaaaaaaaagagttttactagtcttttgaagatttactattttatttttattttgaattgtgtgatctgaaagaattttaaccaaagtccaaatgattcccattccaaaattgtatccaatgtaaaatgtaaaagataaggaagtggagaatttggtatcaggagcccattcagccaggttttttttttttaaatcattacagtacttcccaactctatcagtcctatatcacaaagattctgatacagaagaattatattgagggttttctttttctagtatagaatatatttctgctttactgtctcctttgtctccagcccagctttaaataaactgcagatgttttgttacctggatttaagccttgtcactgctttttttttcttcttcatagctcccagctttttgggtcatatttatttgactattgtcaagtatgtttgtgaccacataattgttaaatctcaatatcctgcatacagttctgttggtttagtattacttttgttattatatgttgactacatctatgaggttaaataccaaacctgggttttatattccttgcctcttctgttttgtcttcatcattctttctagtccctagttcttcttggtgcagcctatgtcaatggccatattttttccctaaattatcatcaaagccagtcaataccacctcatgccaatcaacattttcacttaatttcaatgctttttctaagtcttcttcactggcttcttgccttcatagtttacatgtttacattatcctttacattctccataactttctttctaaatacaaaatgattgtgacctttttcttaagcaccagacaatagaattgccatatttttttttcctacaaaagcaatctggccatcctagctcagaaagcaattgctatccaatggtagattaaatcacatgtgtaacattgccactcttgtatgatcagttctgttgaaaggatgatgccatgttgctacttggtccaagacagctgttgaaaattagcctaaggtaatggaattagtcaatactcttgggttattgtagctaaattttgtgtctgtaaaggttagaggttaaatgagtagtttatctaatcccccaccatcattattccataataaaatgaaagtttatataaatgctgctatattgacttttaaaaacatagacatacactgagcctgatggtgcaggcctttatccctcacttggaaggaagaagctggcagatctctgcgagtttgagggcagctagtctacataattagtttcagacaagttacagatatactgtgagaccctgcctcaaaaagaaaacaaacaaatatgtaaagaagtttgagtcctggaaatgggtatgtgttgaatgtgtatatgtgtgcttcaatgaaaagaaaatctttcaagaaaaaatttgaaccttgtatgacaacattccagagatagaaactagagatccaactgttgacatccaattattcttttccagggtacaggaccaaagtacactgaccctgatagatacttgtaaggatgaggtgtatatccaaaatgtgttaagtaattcatgtgccttgagtatcatggatttcaaagactatatatttaagaaaatgcactgattttcacaattgatcctgatttttaaacttctcttgaactaattagtgacatacctacttttgatctgaaataaagatattttaaatgttttttgggagctgcctctagaatagtcccttgttctaattaaatagctcaacagcatgataagaaaaacctagtgtctccagagaacttacaccaacacaatcccatagtctatagtagaataaattagaaaggaaaacatcaaaataccagccttctttgtttttcgatgcctttgcctggagtttctcttccatgtttatttgaaaagctataatccattgtgcttattttttttccagagcagggtgtttattccccctttccctctgcctgtgagttatacaggtcatggttactcataatcctaatgatgtaagttttagggacattataataaccaacacaattcatattttgaagatgaagatagagatctaattcaatgcttagtattattatcaacattggacaaatgagtttaaacaacctcttaaaatctctacaccatctttaaaaaatgagcacttgttccctgttgaatatacacaaccaactgccatctatgcaatcttagatcacacatatacttagttgttttttttttctcattcaactaccagttctttccttatttgtagattcagaatactgtcctcatgtacacagtgaatgaaatactgtatattcacatgtaattttaaaaaattctatggagctggccttttgttatcttcttttttgttagtggtgagtagtgaaattgcatacagtttttgaattcccaaagaggaaacaaatcgttattttgggtatatgacctattcaatgtcataaactattaaagggagtgtcagtccttcttaacctacctgatattattctcctacctcttctcctcttgttacattaactcttcgtgaggagataggagtaagtatctattcacttaatatagggcactgcagacagataaatgtaacaattccatgcaaatccaacttggtcaatcaatgaattttcagagggcttacttaaagagcatggctgagggatttctctcaggagtagaggtgacccccaaacaactgtttcactataaaaaatctccctccttacacaaggtccttatgaaagctgtatcatagagtcctactttctgttaacctttccattcttagacacacatacacaaacaaatacacacaccacctccaccaccaacaacaacaatagaaataattaaataaccaaccaaacagaaaaaccttagcatatcccatggtcacttttgcttctggtgggatgtgagggcaggagggaataattgctgcattcccaggtgagtgtcctgtgattctcccctaccttcttctaactaggtagtgaaaaatgctccattgccataaatatctctgcactgttttgcttgttttgtggccgtgattaactgtccaaagtaatcactactccaaaattccggatgtgataatcatgttgtgccccaagtaaaaagccacattacaacatctcttaagacatctaacaactatgctagctattaccttcttaaggctgcagagaaaggactttaatacctgttaaatgactctagagccagtttgctatatagttaggatacatttactactaaacagcttcatgaagctgtttttatctcatgtcttatccattctggggatcaagccgatggctttgtacatattagacaagtgtcctaccactgagaaatgtcttagcttccaaggtgctccttcatagatcagaaattaaaatctcaaatgactcagaatttattgaagtcggaagttcagctcacctgtctttgttctcatcataaaagaccacaaatgttgtatttttaccttttaattgacctttgtgtgtatgtgaatgtgaattcaggtacacatgggccatggacaaatttgggggtcaagacagcctcatatgttggtcctttctttctactctgtttgaggtgtggtagctttgttgtttttctccctgacatacgaagattagctggcctgggactttccaggagtctcttgtctcagcatcacagcagcagaagcttcagattctagatgttgctgctactatgtttggattgtacgtagcttctgagaattcgaactcatgtcctcacacttgcagggaaaatgctttcaatctctgagccatgcaactaggacgatggtttaattattgccacttgtcataggcttttaatcttagcactcagtaggctaatgtaagagaatggtaaatttgaggctagcccagtctgtacagacgggccctgtctcaaaagctatgtaatttagtgttccatttaaacatttaagaatgtataggtaaaacagtctggaaaaatatgaaatggcaagcatgtaaactaggccaatgttataaaatatctaattgcttgattcaagctactttatttgagaatatattttacacagactaccataacaaaattgaaattaaaaactagttaaatataggtagagaatttgcctagcatgtacaaacttcttggttttaatcttaaagatcacccccctccccccaaaaaaagcattaaacagctattcaataaagcacaaaggtcaaaatacaaagattataagtttgtaattttaatgtgtatgcattcctttattatttataaagttctacagtatttttaacatgaaaaacatatatcttggaaatgtgaagttgaataggaatgtaaaacatttcctgagacctaagagagaaatgtggccccaattatatcagtgacaacttgtaattatctgttttctgacttagcttattcctaaacatacacctttgactcctccagttttattttagtaacccattttgtgaataatgggctctgtcactttcatttatgttacttctaaatatttgggagtaataaaaaaggcagctgccaacaacatctgacaactactcaatagatattaaagatccagctctcaatctcaaaccatttctcgtatcagcatacctctttctcagacagattcaatacactatgctcatctagaaaagagaacggtcagcttacgtttttaaagatgtgtttttttttttaaaccacaatccatgagttgctcggcttctcaatcctcttacacagtgctgaagcccatagtctcatatgtgttaaagagatggatgtgcttgtttgttagcaccgtaaacaggtttctttctgatatgttttcagtttttctttctctcataaagattacgtaatgatatttagtgttggctctttggtttggttgggattggttatgtgtcttgagacagtactcactgccaactattatgtttaggttggtcttgaaacttgacctcaaaaaagaaaaaaaaggcatccaagtagcttagactatacatacatatcaccacatccaatgtattttattttattttattttattggaattgttgcatgagtaatttattttattttattggaattgttgcatgagtaacttattagcatcatttctatcgttccctctccaccttccaaatgatcccatgcctcccacccttctcaaatgcaaggccttgttctttattatcaacatgcgtatatacacccacacatgtacaaacatgtgcaatagactttacttactgttgctcatatatacatgtgtttaagattgaccacttgggattgcataacctatcagtgacttcatccctagggggaaaaaaaaaccatatccctctcttagcagccattgactccctatagtcttcacttaagggtataattttgtgaaattctcccatcagcatcatcctgggttgttttgttttgttttgttttgtttttgtttttctagtcaccacgtaagtcacgtaagtattatttagacaattttattgttgagaattaatgggtaaaacatctctgttaatgactactggaaacaatcttgtatcaggtatcttggtcttctggcttttataatctttcagtcccctcttttttaatgattcctgagacttggttatacagattatgttgtagatttactaattggggctgggcacagcaagccttcttaataatattttaagttaatatttttatttctttttttaaagatttatttattttatctatatgagtacactgtagctgtcttcagacacaccagaagagggcatcatatcctactacatatggttgtaagccaccatgttgttgcctggaattgaactcaggacctctggaagagcagtcagcactcttaaccatctgtccagcccaatatttttatttcttaactttatagaatataaactctctttttactgtaaaacctaattttatgaaacagtaaatacaatagatatttcagttactttaaaaatgagaaacctgttgaatctattttttaactgattaaatgttgagtttcttattttgtttgcattttattggtgatacatgatagccagaaccccataaaaaccatgcaaagagtaatttaatgattttacttgagattatgatgaatatcagaattcctaccagctgttttccatctctgtagtgggcagaactgcagttggtaactgaacccgcaacagaataagaaacaggctctcataagttctatcactatgtttacttatttttttatacttttaatcattttataagtcaaagttgaaattaaatgatcataagcctctttaaaaatatccaaagtcagggttgttaaatgcagtacatgcataaaagacatatctaaacacgtagctttttctaaacatgtctaaagacttcctattatctgagtctaaaaaaatatgatggttggcatttcattacatttgtttctttgggttttttttgttcattggttggtaatgcaagaagttgaacctgctggtgataccaccagtttaagagttctggcagtttatttataatagccagaagctggaaagaacccagatgcccctcaacagaggaatggatacagaaaatgtggtacgtttacacaatggagtactactcagatattaaaaagaatgaatttatgaaattcctagccaaatggttggacctggagggcattatcctgagtgaggtaacccaatcacaaaggaactcacacaatatgtactcactgataagtggatattagcccagaaacttagaatacccaagatataagatacaattagcaaaacacattaaactcaagaagaacgaagaccaaagtgtggacactttgccccttcttagaattgggaacaaaacacccatggaaggagttacagagtcaaagtttggagctgagacaaaaggatggaccatctagagactgccatatccggggatccatcccataatcagcctccaaacgctgacaccattgcatacactagcaagattttgctgaaaggaccctgatatagctgtctcttgtgagactatgccggggcctagcaaacacagaagtggatgctcacagtcagctattggatggatcacagggcccccaatggaggagctagagaaaatatccaaggagctaaagagatctgcaaccctgtaggtgcaacaacattatgaactaaccagtacccccgagctctcaactctagctgcatatgtatcagaagatggcctagtcagccatcactggaaagagaggcccattggacttgcaaactttatatgccccagtacaggggaacgccagggccaaaaagtgggagtgggtgggtaggggagtgggggggagggtatggaggacttttgggatagcattggaaatgtaaatgagaaaaatacctaatttaaaatatatatataaagagttctggcagtaagctccacacccttactccttcatgactcttgacattgaaatttttttcctactataatcactttgtaccttcaagctacttgcagaattgttggtgctgttgaacacatgacaaaaaattaatatgaccttcttttggggttgtcaaagattggaatgtttgaaattatttttcaataaaagtaaatattgttaatattttattgcttccattgtagaacttactttgcaattttttgacagataacaaagattatgatgcctatctgtcatataccaaagtggatcctgaccagtggaatcaagagactggggaagaagaacgttttgcccttgaaatcctccctgatatgcttgaaaagcattatggatataagttgtttataccagatagagatctgatcccaactggaagtaagttaatgttttctcatgtatatttcatgtgtttgtgttgtaaattggtatgtctatgtagtctcatacatggcattttagtgtctcaagaaacattttttgaagaaatttaaattttatatgccagaagatagtttatttttctacaaagcattgtattttatgatccttaatatttatttaaatcatctgtaaaaatatctctgatatttttagaatggagccaaaactccattcaaagtgctaattcattgtttcaccttcacaatgtgttaactgacacacaattcttaactactatgtgagcaaaactaacaaagacttttggagctcttatcagttcacttatcttgatccacttttttttttctttatagcatacattgaagatgtggctagatgcgtagatcaaagtaagcggctgattattgtcatgaccccaaattatgtagttcgaaggggctggagcatctttgagctggaaacgagacttcgaaacatgcttgtgactggagaaattaaagtgatactgattgaatgcagcgaactccgaggaattatgaactaccaggaggtggaggccctcaagcataccatcaagcttctgacggttattaaatggcatggaccaaaatgcaacaagttgaactcgaagttctggaaacgtttacagtacgaaatgccttttaagaggatagaacccattacacatgagcaggctttagatgtcagtgagcaggggccttttggggagctgcagactgtctcggccatttcaatggctgcagccacctccacagctctagccactgcccatccagatctccgttctacctttcataacacctaccattcacaaatgcgtcagaaacactactatcgaagctatgagtacgacgtacctcctacgggcaccctgccacttacctccataggaaatcagcatacctactgtaacatccctatgacactcatcaatgggcagcggccacagacaaagtcgaacagggagccgaatccagacgaagcccacacaaacagtgccatcctgccgttgttgccaagggagaccagtatatccagtgtgatctggtgacagaaaagcaaaggacatcccgttcctgggagtttgaaaggaatctgcagtccagtgcctggaactcaatcctcgactgctgctgttaaaaacatgcattacaatctctagaacacgaggaaaaacagggtcttgtacatatattttttggaatttctttgtagcatcagtgtcttcatgttttaccatgtctcttaccattacattttttgactttgttttatatgtcattggatttgtaaatttacattttttttaaagaagagactgatgtatagatagaaactccccctcccttttttgcttcactaatttagttttagaatgggttttgaatcttctttttaaattttattttgcttttaacatttccttggggtgcttggacaaatctatctgatgggacaaggagcaccggatcctctctcgggttcttcctaggaccagcttggccatatgggccttcagaaagcagtgcgactgaacgccaggcttgcattgccatttgggaacaaaagagagagagaaagagagaagaagatctgttcataggagggccctgacttcagagccctgaaatctcttccttgtccccacctcattccccacctctaccctctaatggcagcatgatgtgtaaactctgcagggggtagggggaggtctaactgtcttaacattgaattcactgctcttcagaatacactctagacccaaagttgtgctagtcattcaacagtgaccactacagagtgctcactacagagtgaagatcatgggcatgaaaatggggagagtgttgtttccgttttttaaaaaatgagttgatgtatccttatatatataaatataaatatatatatatatatataaaacagcaaaacaaaacaaaacaaagaaaaaaacacacaaaaatacaaaaccaaaaaaaaaaagccctatatttgatcacttcctggaaaggcatgaatgtgtttgtggctgtttttgtttgataatctacttcctcttttccctctataattaatttttctgcaaatgagattatgtgcaaataccaggcaagttaactcagataagtgaatcaaggcaagtaaaaatgaaatttacactgaaagcttccaaaccaaagggaagaacaggatgtgtcatcaaataggttttgttaccttgtattatacaaaatgttatcttctaaaaaagagtcagaaaaaacaatctgtgaaacttattgtggggtccccttgtccttaaatgttaactgacttgtatttacttctcaatgctacatgcagaacttaagtggtttcagtttaagaacataaacagcatttattaatatcaaggttgtttaaataatatctcaggaggtcaaacttatgaataacaacacaaactactactttcaaaataaacattatttacacaaaatagttttaaattagatcagaaaatacttaaaatacttaatttttgtatagaaattaatttaattttaactatatgattctatctttcagaaacagaaagttgatgctcccaggaaatttgtcacttactatctagctttatgttggaaatcaatcacataagcagcgaattccctctcatgttaactatgatgctaaatcaatcacgaaagatcctgcagaagacagaattcttaaaaggacaatgttacctatgtagactttagttttctttaaaagaaatcaacgtgacaaaaccactgataataaaccttaggctttatagaacttactttagtaagtcatcatgggaaattcctactcagtcatcacctgtgggttcatgtagtgactactctgtgtttgcttaattcctgccactccctataaggagaaaacaattctagagtttgggtcaaaggctaagatgtaagtaggccatagacataaaagtaggaactgcactagagttcactggagaggacaagctagaaccataagcataggagagacaagtacaaacatttgtaacaatgcaaaggtctcagtgtctgtgtgacaaggcaaaggagccttgggacgtgcattgatttttatttgcttaaaaatattgacttccctgacaacttgcctgggtcttctctacagtatgtctctattcttgtgctccccttggttctgtgtcacattttcaaaaaccagaactgaagcttcaaggacagctaaacatttcaggtcagctttgcacacttgggttattttcagaaacggagaaggccactgtttccttcgtactatggacacttggcattggactggattccaaactcccccaatactcacaagagtggaaatgtggcaatggcctgatttagttcttgtttgtttgtttgtttgtttttaattttttaagtgcacgatgggtgtgtggaataaatgtaaaggaagtaatcagaccacagtcatattttaggcattcataggtgttaatttagctgcattgggagtacattttttgttctatttttagtgtagatttaagcactttgaatagcatgattcagggattgatgggtaatatttgatactctcacaatgtaagaaacgtttttttcctccaatgctttgttatatttacaaatgaaataaatgcaaaggaagctatctatagctttagaaacattcctcccaagtttctattcctctatcagctccacatgagaaccagagaagggaactcatgggttcacgtgttctgtgtataacagaagttctgtgagaactcaataaaatgaagagaaaaaaaaacatgtattttccctagtgcttaggtttcatccttctctttctgtttgtttggggttctggggtataagattattctagctataaaaacacatttgaaaatgtgaatgtgttagccaagctgggggaaagaatggacttccagacttggacacgtgtgatatttggtattgcctgtttttcatcaatcaccgcctgagctctgaatggtacattatggattcaaagtccatttggttctttagtgtaacctcaacttgctgcttctgagcatcttagtctttattctggtgctcaaatctttgattatttaatttgtatcccatccctttggtcttcaacaggcagagaagacctttgtatgttgtgttaccagctgatctaagcttagatgaagtctatgaaatccaagacgtgatgagatctgaacttactatatttctatagctaagcatatgattgttcagtcaaccattttgtgattattattttttcatactgtatgtatttggactctatcaacttaatcttaaatatgtagatgctggtttctttcatatttcattgttaatacatattttgtaacaagaggaaatattaactaagagccaattcctaaactctaagtatgctttgttcatcctagaatagtcattaacttttcagagactatttatgtgaattgagattactatttctaggaaaacattaatttgtacattataagctattttctgattctgtaatggtacccttgctctcattttaaagaagtttttaatcttgtgtttattttttctcttttatttgttgttttgtttattttgtttttgagacaggattcgggctgggctggcttcaacctctcaattctcctgcctcagcctcttgactgctgaaattttaggcatatacacccaaaccaccaatttcttctttattagtttaggtgtatacattagtcccacaagaaatcttattgacattctaaggagaacatcaacatcacacaagtgaaataattgaatggaactaagagaatatacatatacaaaagaggaaaatgtctttttgtctctgatctgaatttgtttgaccattcattccatcactgctgtagttgatgaaaaatagaggcaaaatattaaatagcttagacatcacattacagattcctattccctactgtggaaaatttttccaaccatacataaacggttattaaaaacaaatcacaatgtgactctgtaataagcgaagaagattttgtcaatggaagcagaggttatttcttgccttattgtggatctttcccgcctgattattctgaacaaagaaagtagccaacagtttcaattatccttattaataggccttacacttgagtttcagggatatcgtggttctataaaataaatgaaaggaaataacgaaacacgtaaatctgttttcctgggtgtgactctcaagacatccagcatccaagaaagccatagacgtttagattcagagaacagtcttttatgctaatattaatataaactcacattttgtgaaggcattgttgtgtccttgatttttttatcttcatttatgaaaattcagggtcacttttttttttaactaagattgctctccatccaaaatgagctaactttttgagagaaattgtgtgaagaaaaatttaacaataataattaataaaatccataattttcaaccaaatatatgaggaacctatccattattattagtttagtttattcatttttatactcatttaaaacaggaggatatgcaaaaatcctaattttacaattatgacttacttcattaattttttgtttgtaaaaacacattatctgccaaaaaattcaaacagtagagaaagagaagaaatacccatttgatgtgtttttctataagaaaccagttttattatgaaaatgtttagagtttgttattgacttctcttttggtgattacaattttgctactttcatgaattcaaatatgaccttggaacaatatatagaactttgaaaagtgaggtggtgataatttaaagttgcaggttttttgtttgtttttgtttttgcttttgtttttattttgttcattgcagagtgaaaacctatgctctatggtaaagactgtcagaaggagctgtaaaaatcctagttaaataaaacaaaaggaggaagaagagaaggagtagaagagttaattctactcttaatttgatgtgcccttatcatagtcagcttttggttacatccatagaaaatgttttaaggaaaaataaaaggagatcaactttaattttccattcagcattatatcttttttactgactcagaacacaagatgtttctcgattacagataagataggcatatatatttataagatatatatggctttataaatatatatgtgtgtgaaattccttctgttcattagtaaattttcctctaatagcctctgcgttcactgacaaactcattcttctgaattcttcattaaagtaagttacttttattttttttctatttactgctttcattgatatatcccccaatgttcataaatctgaattttttctcatttttaacacaaggaagcactctaaaataaaatcactacactgtgttccctctactaccaaaatcaacctcaaaaaaaaaaaaaaaactgcccatgaacttcagagtactaagtgtaatatttatgttgtaaatttcaatcttcataatctaaatgttacctttcaaaaggcatgctgtgtcatttaaaaaaaaaagagttaatgtgaaatgaccttattacatagtgcatgaatacgtggcaaagtattacggatctatctttactagtcaatgagaggttaaatttggggagatcagatatgttttaggctaatgtcaattggaaggatggaatcttaatgttagcataatgggcagttttccatactgcttgcagtatatgctcctgttaacaacaatccttagtgtactctttccaccaaagtagtggagatgtgttcatataatctgctatttaattacaacttttacaacttcagaaattgagggaacccaaataggaaagtgtatgtaatcattttcctctgctggcgttcaagttgtattttaaactcagacactctcagatctgttcacagtcagtacaagtgcattttacatagtacttctcttgagttttgctcaccctcttttgactttgtacaatctaggatgtaggtgactcatgagtaggtgatgggggcgctcctttttttcttagaatacttacaattatatatttggttttgctttgactagcaataggaaaatagacaaatacaagtgtacaaatgagaaattttaacctcgacttataatttgtgttttatagtcgtttcataagtctgttgctctctatgagtatgctctctatatatcctgtaaaaataaatttatatgttacatagaaattcaagaaattaaattatttattaagctacaattgtttcttctgatttctacctgatcatagatgacaataaattaaacaatgtgttgttggaacatatgtaagtatgcttgttaatttaataattttttatactgttctttctctttccttgtatgttgtttaagctaataattcttaggcctaattcctatggttgtgagcagagacttaagaaatgccctagttggttggggaagaaaaaaaacaggcttgttgaggaccaagattatttgcattcctgctttatccttcactgttggatttagagagatttgaatcactaattcaagcactttatcattaccacatgaatggtcttttcaaggtaaaaatccacatttcctttgagaaacagaaatgaaaagaatgagaacatgtcagtcctctgctggctccctttcttctgggtattttcttttcttttcaaggtactactgacatgattatcttaaaatattgtcccctctgaaaatattttacagtgaccaaggtcttgaatcatcttgttttccacttctaatgcatagtcatccctaaaaggaaatgtcttaggtcatactttttgttttttagttgaagataaataaccttattattttcttatcagaggtgcaggtggggttgtggaatgatggtaaatcattccgtcaaaaagaagcaatcatgaacctctttagcatgaattagctgctcatgcagaattcctaccataggcagacagctgtttaagaaacatttttcatcaatgaagcacagataaatcatgaagatttaaagtaatagtttcaaagcactctgtaaggctactttaagttacatttcaaagaaattaacatattgaatttttcatacagtcatttctacctaagttaggtttttaatttttaattttccccttttttttggagggggcattgagacagtttctttgtatagccctggctgactggaattcattctgttgatcaggatgggctcaatctcagagaccctcctgcctctgcctccctgggccaccactcccgagctctcagtaggatttttaaatgtgagaaaataacttctactggaagggtaaaatcccatcaggattatttggcattgtctaactttaatagcatatgttaaatcacaaattccagaatataatgtttaattcaaaatatcagttgaatagttaaagaatctgtggtgttacttatgtacttcaaaaacatacatacattttctattatactcatcttattgacaggttttaaaagattaagaaaaagagagagagaacactttacttttagaaaatccttaattcatgttggatacactgttaacaacaaaaattaaaatgaaaaatatggcaaatatttagaaaattataataccggtgacccaatcacttattgctatgggctttataatattcatacatagcctctagaagctatttgaacaaatcccttaatctatcctattttctccatcaataattactatcataaggtaatgtgcgtaatgttgcaagatgcagttccagataatagtgaacattgctattttgccaattgcttagtaaataggttggccaaactaggattttttaaatcatccttatgtaagttcattttgatttgcacagcagaagacttgtatttgaatagttacacattagaattaagatttcacaagacttcaaaaatgtaagttaaatatcaaacttgagactttatggatattcttctttatgattatgattaaatgatagaatgatagatgaataaactgaagcatatataaataggaatctaggaaaggtgatacatggcaaatatcatccaatgacttgtatatttgaaaaatatatatggaggttggttttaaaaaagaacaggaaaaaagtgaacacggacaaaagacaaaattccccataatatagagagcagaatgtataaaaagtcttcatgaaaaatcaagaaaattataaggttataaacattaatgacaggcttcagtaaaggaaacagtcttgtctgactactgtgcttggcagtcaggaggtattgcatattatgaaattatcagaaaaacctggtctctgtgaattctttctcggaagatctcaggctaaatggaaaagcatttctcaatttttctaaattagatggataatggattactaaattctgtaacatgaatacaaatagtgatttttggcatacagtggcacaaaggttttgtgagtgatgaagttgtacttttataacatgaagtgtattagtaataaatagttcaaaaccctggatatgtttagaataacctgaggtttaaaaatatcagcaaatgtcagaaatctagaagaaactagctactccgagtttgttattaatgtttgagtttctcagtgaactctccagagaatactcttcacagattaaccaaaatagaaaactgtacaaaccaaaccaatgggtctgaaacttgtttctctagaagagtagcctggaaacctgttgagaagtgaaaattcaagaatagctgtataactagtaaaggccctggattcaaactccagcatgaaataattctaagtggcaattcgactgaacctagtaagacatagtatcaaatgtattataataggtttcccaggtgatcatgaagacgaggcccatcaatccctcctgagaaaacgggtgtggactgtgtccttcctctctttcagcctcctattggtctttggaatgtaaaattaagaactgtagcagataagtggtatcctagcctgggtcatcctcttgaaataatctctccaaaaaggtgatgtccaaatacctaaggaaaaacattaacactacaaaattctacacatttcacaatgtttgaagagaaagacaaagtgaaaaagtaaaaaataaaaaaataacaaagtccagcactgaaatcaaatatatggcttctaaaagtaattgtgccacttagcagaaaccataaactaattagcagttgtgtacttaaagtaaaccttcttataaaagaatgcaaacatattatcagtgattttatctataaagaaaacagtgcaactatataggaatattaacaacattgactgtcaaaataaacaaataaatatcaaatttgttaaattatttaatcaattttccctccagttaataatttattaaataaattaactctacaagaaaacatccatgttctctctgttctttagcataagcatgactttacaacctgagtctactgtctcatgcctgtaatcttaccattcaccttaaatcatgttcactgctccctcccagccactccctcccacaattcttcccatatcccctcccattctctgagagcgtaggtaccccgcctatgtctcccccctccctaaccctggcacttgaagtctctgcagagctaagtacttctcttccactgaggccagacaaggcagctcagctagaagaaaatatcccataaacaggcaacagcttttgggataaaccctgctccagttgttctggactcacaagaagaccaaggggcaaatccatatacatacaggtgtgcctaagtccagttctttggttggtgggtcagtctctgagagccccaagggtccaggttagttgactcttttggtcttcttgtggagttcctatccccttctgggctgcttcccttcccctaactattccataagagtccccaagctacatccactgtttggctgtgggtctctatagccatctgagtcagctgctgggtgaagcctctcaagaggacagccatgctagattcctgtctgaaagcataacagagtatcattagccatgccagggattggtgcttgcccacgagatcggtctctagttgggccagtaattgattggccattccctcagcctctgctccgtaacctgtccctgcatttcttgtagacagaagacattttgggtcaaacattttatgggttgggttagtgaccctattgctacactggggttcctgcctggttatagcaggtgacctcttcaggttctatatgcccaaagctacaagtcatggtaaaggataccttcattgaatgtaggagtttaatactattacagagcatatttcatattctttatttcaacattcacttattctgacaatgcagtatcagtcagatatatttatctcgctagattaagttatttaatattgttcatgattttttttttgtagtgtagtatttggggaaacatttttgatgaattttccaaatctcttactgccagatgggtacaaaagaataaaacttctggttattttcaga

SEQ ID NO: 72 - DNA, 2653 bp, Mus musculus
ctgatggatgcacagattggtctgttgatatcaagaagtaccaagttttggtgggagaacctgttagaatcaagtgtgcactcttttatggttatataagaacaaactactcgctcgcccaaagtgctggactcagcttaatgtggtataaaagctctggtccaggagattttgaagagcctatcgcctttgatggaagtagaatgagcaaagaggaagattccatttggttcagaccaacattactacaggacagtgggctttatgcctgtgtcatcaggaattccacatactgtatgaaagtctccatctcactgacagtgggagaaaatgacactggactttgctacaattccaagatgaagtactttgaaaaagctgaacttagcaaaagcaaggaaatttcatgccgagacatagaggactttttattaccaaccagggaacctgaaatcctttggtacaaggaatgtagaacaaaagcatggagaccaagtattgtcttcaaaagagataccttgcttataaaagaagtcaaagaagatgacattggaaactatacctgtgaattaaaatacggaggctttgttgtgagaagaacgactgagttaactgttacagctcctctaactgataagccacctaagcttttgtatcccatggaaagtaaactgacagttcaggagactcaactaggtggctcagccaacctcacctgcagagctttctttgggtacagtggagatgtcagtcctttaatttactggatgaaaggagagaaatttattgaagatctggatgaaaatagagtttgggaaagtgacattagaatccttaaggaacatcttggagaacaggaagtttctatttcattaattgttgactccgtggaagaaggtgacctggggaactattcctgttatgttgaaaatggaaacggacgtcggcatgccagtgttctccttcataaacgagagttaatgtacaccgttgaacttgctggagggcttggcgctattctcttgctgctcatctgttcggtgaccatatataaatgttacaagatagaaatcatgctcttctacaggaatcattttggagctgaggaactggatggagataacaaagattatgatgcctatctgtcatataccaaagtggatcctgaccagtggaatcaagagactggggaagaagaacgttttgcccttgaaatcctccctgatatgcttgaaaagcattatggatataagttgtttataccagatagagatctgatcccaactggaacatacattgaagatgtggctagatgcgtagatcaaagtaagcggctgattattgtcatgaccccaaattatgtagttcgaaggggctggagcatctttgagctggaaacgagacttcgaaacatgcttgtgactggagaaattaaagtgatactgattgaatgcagcgaactccgaggaattatgaactaccaggaggtggaggccctcaagcataccatcaagcttctgacggttattaaatggcatggaccaaaatgcaacaagttgaactcgaagttctggaaacgtttacagtacgaaatgccttttaagaggatagaacccattacacatgagcaggctttagatgtcagtgagcaggggccttttggggagctgcagactgtctcggccatttcaatggctgcagccacctccacagctctagccactgcccatccagatctccgttctacctttcataacacctaccattcacaaatgcgtcagaaacactactatcgaagctatgagtacgacgtacctcctacgggcaccctgccacttacctccataggaaatcagcatacctactgtaacatccctatgacactcatcaatgggcagcggccacagacaaagtcgaacagggagccgaatccagacgaagcccacacaaacagtgccatcctgccgttgttgccaagggagaccagtatatccagtgtgatctggtgacagaaaagcaaaggacatcccgttcctgggagtttgaaaggaatctgcagtccagtgcctggaactcaatcctcgactgctgctgttaaaaacatgcattacaatctctagaacacgaggaaaaacagggtcttgtacatatattttttggaatttctttgtagcatcagtgtcttcatgttttaccatgtctcttaccattacattttttgactttgttttatatgtcattggatttgtaaatttacattttttttaaagaagagactgatgtatagatagaaactccccctcccttttttgcttcactaatttagttttagaatgggttttgaatcttctttttaaattttattttgcttttaacatttccttggggtgcttggacaaatctatctgatgggacaaggagcaccggatcctctctcgggttcttcctaggaccagcttggccatatgggccttcagaaagcagtgcgactgaacgccaggcttgcattgccatttgggaacaaaagagagagagaaagagagaagaagatctgttcataggagggccctgacttcagagccctgaaatctcttccttgtccccacctcattccccacctctaccctctaatggcagcatgatgtgtaaactc

SEQ ID NO: 73 - protein, 664 aa, Mus musculus
DGCTDWSVDIKKYQVLVGEPVRIKCALFYGYIRTNYSLAQSAGLSLMWYKSSGPGDFEEPIAFDGSRMSKEEDSIWFRPTLLQDSGACVIRNSTYCMKVSISLTVGENDTGLCYNSKMKYFEKAELSKSKEISCRDIEDFLLPTREPEILWYKECRTKAWRPSIVFKRDTLLIKEVKEDDIGNYTCELKYGGFVVRRTTELTVTAPLTDKPPKLLYPMESKLTVQETQLGGSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLICSVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTATAHPDLRSTFHNTYHSQMRQKHYYRSYEYDVPPTGTLPLTSIGNQHTYCNIPMTLINGQRPQTKSNREPNPDEAHTNSAILPLLPRETSISSVIW

SEQ ID NO: 74 - DNA, 59365 bp, Homo sapiens
  misc_feature (1)...(59365): n = A,T,C or G
atttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaaaccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcgtcagtgatgtaaatgagttctttgcggaatcaaattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaagatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcactgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgacgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcagtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcatattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagacctttttttttaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttatttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaaggtcagaatcatttaaccccttaagagacaatattaagatggatgcattagattctgaaggttaataatgtatccatttgtatattgccatacaatcagttnnnnnnnnnnnnnnnnnnnnttcactattctatattatgataataacatattattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagtaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggattttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaaaaaaacaaaaaacaaaaacaaaaaaaaaaaaaaatcaagccctatatttgatcacttcctggaaaggcatgaatgtgtttgtggctgtttttgtttaatcttctacttcctcttttccctctataatttctctgcaaatgagattctgtgcaaatgccaggcaagttaattcaaaagagtgaatcaacgcaagtcaaaatgaaatttacactgaaggcttccaaaccaaagggaaggacaggatgtgtcatcaaatatgttttgtcaccttgtattatacaaaatgttattttctaaagagtcagagaaaaatctgtgaaacttattgtgcggcccccttgtaattaaatgttaactcccttgtatttaattttcaacactacattaagaattaagtggtttcagtttgtggacataagcaacacttattaatatcaaggtgtttaagaactcaggaggtcaaacatatgaataccaacagagatcagtattttcaaaataaacattatttatacaaaatagtttttaaattagatcagaaagtatttaaaataattaattttactgtataaagaatttgctttattttagctatgtaattctatctttcagaaaacagaaagctgatgctcccaagaagttcatcccttaccatttagctttatgtttgaaatcaatgacataagcagctaattcatattcatgtgaaggttgatgcaaaatcaatcacaaaggaatctgcagagggcagagttgttaaaaggaaatattacctatgtagcttttagtttttaaaaaaaatcaatgtgataaaaacactgataatagaacttatacattaatttagtgattcattgtaggaactcccatcccagtcatcatctgtgggcctgtgtagtgactatcgtacgtttggtttattcctaccaccatttagtgagaaaacaattctacacttttggtcacaatagtaaggtggccacacacacacacacacacacacacacacgtgtaaactgcaatagggttcattggggagggtgaggttaatttgcaaatatatgaagaagaagtgtaagcatttgtaacaatgaaaaggtctcagtatctgtgtgacaaggtaaaggagccttgggatgtgcattgattattatttgcttaaaaattgtttatttccctgacaactcgcctgtgtccttctctataatctgttctttattcccgtgctctccccttggatctgtgtcacattttcacaaaccagaactgaagctgcaaggacacataaaactttaaggtcagctttgcacattgggttattttcagaatctgagaaggccattgtttactttgtactatggacagctgtcagggactggtggcagtgtacctcactggactggattccaaactcccccagtgctcagaaaactgtaaacgtggcaatggcctgatttatctctttgttttttaatttttcttttcagtgcacgatggaagtgtggaataaatgtagaggaagtaatcagaccacagtcatattttaggcatccataggtgttaatttagctgcattgggagtgcattttttgttctatttttagtgtagatttaagcactttgaatagcatgattcagggattgatgggtaatatttgatattctcacaacttatgaaacttctttttcctctaatgctttgtcatatttaaaaaatgaaataaatgcaaaagaagctatctatagctttagaaacattcctcccaagtattcctctatcagctccatgtgagaagaaatgaaggaaactgtcatgtgttcacgtgctctatgtttaacaaaagttctgttagaactcacaataaaaagagaaaaaaatcaatgtcccctagtgcttaggtttcatccttcgcttttttcagtgggggctgtgggggataagaatattctagttgtaaaaacacagttgaaagtgtgaatatgttagccaagctgggggagagaatggacttccagacttggacatacgtgatgtttggtattgcctgtttttcatcaattgccgctcgagctctgaacgacacattgtggattcaaaagatcatccggttctttagtgtaacctctacttgctgcttatgagcatcctaccccttatttgggtgctcaaaacttttgcttatttaatttgtactgcattccttaggtctcctgtgggcagagaagacatttgtatctcatgtagacagctgatttaagtttagatcaattctatgaaacaaatctgagacatgagttaagagacctgaatctactatatttctatagctaaaaacactcgattgctcaaacagtaaaccactttgtgattataactttcttcatagtatatgtatttggaccctatcaacttaatcttaaaatatagatgctggtttcttccatatttcattgctatctagcattttataacaagaatattaactgagagccaacccttaaactgtaagtcttgtttatcctagaatagtcattaacttttcagatatcatttatataaattaagatcaccatttctaggaaaacattgattcatacatttgtgaattatttttggattctggaatgatgccctagttctcttttttgtaaggagtatttttttaatcttgtgattaatttctttatttattaggttaagtttgtaacattagtcccagaagaaagcatattgaaatttaaaggatagcatcagcatacaaatgaaatgactgactggaagtaagagaatacacagacatagaagaggaaaatcccttcctgtctctgatctgaacttgcttggtcattaatctcattattgacatagctgattaatagaggtgaaatattattaaataggttagaaatcccatctacagacagacacacattccctattgctgaggaacttttctaacagtatatacagttattaccaaaagatggtgatgcaactagaatccctaaaaggagaagcttatcaatggaaacagaggctattccttgccttatcatgaatcctttacacttctttattgttctgaacaaagaaggtaaccaataatcaaagtttgattatccttaatagtagatcttaatcttgggttcaaggataccttgtgtctataaaaaggaataaaataacaaagcccttgaaattccagacaaaattgttaatgtgcgtaaaacggtgttcgtctgggtgtgagtctcaagacatctagcacctaaaaagctactgatgtttggatttagaagatattctcagaaactgatattcagataaacccacataacttacaggcattgttttgtctaccactgtctaccttcattcataaaaactctggagataattattgttctactagagacaagtctccttccaaaatggcctggctttgtgggagacccagcatactgtaaacaaaaattttgtatgatgacaaataattcatgctcagataaaaactaattggctatcattgttgtgataatcttactcatgtcttcacccattctaaaaatagtttggggtgtgtgaaattatgtcatttggcaatgatgccttatttcagtaaatttatttatgatttatgtttaattatttttcctacaacataactaagaattcatccagtacaggaaaagaagaaacaaacatttgacatgtttttctaaaaaaaaaaaagaaaatcccaccaagtttttttttaggcaaagatttagaagtggctatatatttgattttcaacaattatgattttgccagtttcataacttatgatatgactttggaggaatatgaagaattttgagaataaagttaggtagtggttatttaaagttttactcttacttgcgattggtagcaaggtgaaaggttattctatgttaataaattgagatactgtcacaaggagctttaagatctaaccaaatttgaataaagcaagagaaggatgatatgatgatgagttaatcctaatcctaaatgaatgtgccttgtcatcatcaaatttccatcacatccatagaaaatggatataattttggatgtaaaaaaattggagctcaattccaatcttctatcaagtatcatttcttccttctaggctcagaacataaaacatgcctgtgtgtgtgtgtgtgtgtgtgtgtgtgtgtatgtatgtatttctcttgctcatttgaaaatttttctctaaatagcctctgggtccactgacaaactcatgtttctgaattcttcgttaaagtaagtaaagtactattgtttcttctaccattcactatcttcattgatgcattccccgtggtccataagtgtttagcatattctctttttaacaagggcaatcactcttaaaaaatcattacactatgttctctccactactaaatgaacagaatcggaaaaactgcacatgaacttgagagtattacatgtaatattgatgtgtaaattttaaccttcataatccagataacattaagtttcaaagggcatgctgtgtcattaaaaaaagatttaatgtgaaatgacattattacatagtgcatgaaaatgtggcaaagtaatttggatctatctttactagtcaatgagagattaaatttggggagatcagatgtgaccgtttaggttaattctcaactgggatgaagacatcttaatgttaggatacatgggtggttgtccatattccttgcagtatatgctcctcttaactagaatccttagtgtattctttccaccaaagtagtggaggtatgttcacataatctgctattgaactgcaaaaacttttacagtttcagagtttgagggaacccaaataggaaaattgatggagtcattttcctctgctggtgttcaagtcagatttgaaactcagacactctcagatctgttcaacagtcagtaaaaagtgcatttttacatagtgtttccctttagttttgcctaccctcttgattttgtacaatctagaatgtatgtaactcatgcgtaggtgatggaggcgctttttttcttagaatacttacaattatatatttggttttgctttgactagcaataggaaaatagacaaatacaagtgtaaaaatgagaaattttaaactcaaattataatttgtgttttatagtcgtttcataagtctgttgctctctatgagtatgctctctatatatcctgtaaaaataaatttatatgttacatagaaattcaagaaattaaattatttattaagctacaaatgtttcttctggtttctacctgatcataaatgaaaataaattaaataatgtgtcgttggaacatatgtaagtacgtttgttaatttgataactcttgttaaacttttccttccctctttttatgtctgtataaacttataattcttaggcctaattcctattgtgatggtgaagaaagagacttaagaatgcccagttggctggaaaaaaagaaaagaaaagaaaaaccttctttaaaaatcaagcccatttacaatcccttttttttcttcactactggattaaggagaggtttgaatcagtaactcagtaacttaaaagtcattatcacattaatggttttctcaaggttaaattccacatttgtccctttattttataaaattatttgagaaacagaaatgaaaggaatgataacatgtgagtccttctttgctgtttcctttccttacttcttgctccccaggtattttattcctttctttttaaggtactactcacataatgaccttaaaataaagtcccctcaggtaacattttaaagtgaccaagatctttaatcatcttgtttttctgctctgttcgcatctacttgaagtgcacagtcaatcctaaagggaaatgtttttggccttacttcttaagtttaagataaataaccttattatttatttgggaggaggagaatggtggtaaatctttccatcataagcataacaagtgaacaaccataagcgtcttagaatgaatgagctgtttaagcagaatgcatatcttaaagaaacagccttttaagaaacacttatcaaagatgaagcagacatgaatcattatgaaaatttaaagtaatagttacaaaaggccccgtaaggttattttagattggatttcaaagtaattagcatatttaaactttcttaaagccatttctacctcagtaggatttttaaatgtgagaaaataaactattgaaaaaataaaatgttataaggatcataaatcagtgtataatttgcatagtacattttaaattgtgaatcatattatagcatatgacccattattcaaaatatcaggagagacctctatagttgaagaaagtttgggattgtttgtgcacttcagacacacacataaattctcaggaattttaattacattcatactattgacaagtggttaaaagactgatatgggctgggcgcggtggcttacgcatgtaatcccagcattttgggagactgaggctggctgaggccaggaacgtggcctcaaagactttgagacaagaatgaggtggatgtatttgaggaagaaaaggaaggccattggctgggcgcggtggctcacgcctgtaatcccagcactttgggaggccgaggtgggtggatcatgaggtcaggagttcaaggccagcctggccaacatggtgaaaccccatctctactaaaaatacaaaaattagccgggtgtggtggtgcacacctgtaatcccagctattcaggaggctgaggcaggagaatcacttgaactattagggaggtggaggtttcagtgagctagtatcatgccactgcactccagcctaggtgacagagcgagactccttctcaaaaaaaaaaaaaaaaaagaaaaagaaagaaaaaaaagataaactgatattaatgagatatcttcagaagattcctaattaatatcagctctatatgggcaaaatagaaacagagaatgagaaaaaaataagaaaatcataatagtggtgacccaatcacttaattgctgtgggattttcagcatttatatatggcctgtaagagtaattaaaacaaattccttaagattgcattttctatcaaggtttaatgcctggtgtcaccattctaaggcaatgtaggtactgcagaacccagatgagtatgtggtgaagggtttagtaagattctgaaggatagagaacatctcaatttgaccaataatttagctaactgttgtttgactaaattagatacttttatcctcagtgatatgtcagttgggttttggtggtacacagagggagattattatttgagtagctctgtatttgatttaaaaatcgccagtatttttaaaaaactttagtacattacattaaactcaagactttatggatactcttaatagttttgcttacacagtagaataatatatatacaccgttatttaaattaagacataggtaaataatattctaggaaaggtgacatatggcaaaagtcatccagactgtgaatgactggtttatggaaaaattgaggccaattttctaacctcttgaataaataaacaaatagacaaacaattactaataaaaggtaaaacgtctcaaaaaacagaaaagaaaagcacacaaaagccagcataaatgatagcactataagtttatgaaaatcaatagctggtttaaattaagcaaagaaatatcctacttctatagttcttggcaataaagaacaatattgctctttataaatttagttaagaaagctaaatccagctttgccatggaatatgtgacttctaaaaagtaattgtactgccacttagcaaaaaaacaaaaataaaaaataaaaaggaacaatattgttcttggcaataaagaacaattatgaacttgaaaagaaaactgggctcagaacgcaagtcatttcttaggtggtctcaggctgaactaagatccatttctcagtatacttttcctaaatgaaatagaaattgtattacgaaatattataatgtatggatagagataataactttggcatgcttgatactgtgacataaagatttggtgaggggtgaaatagttcatagcatccttccaagggatctattaacaagaatttgaagtcctagattcacttagaatcacctgggaaggtttaaaaagtcccggagtcccaaatattcagacataaccaagcagtcttgtgtttgtacctaatgtgagcattttttaagtaagctcttcacatgattccacagaacaaccagagttgaaaactattcaatgatgcaggtctccaattttaggcaccagaagaagtgcctggaaagcttgttaaaagtgcacatgcagattgagcctcaatgggactgaagtggggcacaaaatatatttacttaacaaactttctaggtgattctaatgtggaggcccacagaccactctgaaaaacacaggtgcaggattcgttgtttctgtaattaaaaatgccgccactctgtggaatgcaaaattgaagattccagcagacacatatcaccataaactaggtcttcctttttaaataattcctcccaaattgctaatcagaactcatgatgaagtcttgatttaaaaaacctgaactatagaaaattacactttgagaattcctcatgaagaggaaaataaaaaattagttaagaaagctgagttcagctttgccatggaatatgtggcttcaaaaaaagtaattgtatcatttagcaaaaaaaaaaaaaaaaaaagtaattaacagttaagtgttaaataacaatacatctcccttctgagagaatacaagtctactgtagcttctattttttaaaaatagcaaaatttgacaggaatgccaaagacatttgttgtgaaaataaatatacaaatattaaattagttaaattagttggacttaattaacaattatgtttactcaagttaacaaccaattcatcaaaagattaacaccaatgaagggttttcaaatgttgcttagcataagaatcacttacagcatttgttaaaagcttgaatgagttcctggctcacattccaaaacaattgaactccaggaaatttttacaatcatgtaatttggggagcattattctagtaaatgtcataaactacaaggctatcttcttacagtgccaataaatgtagttaattctacatgagatgatcatttaaacgcattatcttgcattttttcagcaaaatgacaacctacgcaacgatgacaaaccagttggttctttattttatccttcaatcgcttactctgacaatacagttccagccacgtatgtttattttactgggctaattttgatctctagactccttgttttgcctgaaatgactaccagagttgaggttgttagcttatgtttcttaaggagaatgtattatttgatgtaagattctcatgaaccaatcatgtcactgattctaagtattaatacatatttcaaggacatgattgttgttagttgaaagaaaaatattcttatacatccttcacagagtagccacatcaaagagtttctggagagttggctttaagtttctaaagatcccactcataacctagtgacttccacagtcactgtaggccttcttaccatctgggcctttataacactagaacatgcaaaaaataatattcaacagtaaattttattgggtgaagcatagcctttgatatttctacactaaactgaaaaatataccaatttagcttgatttattttcagaatgtattctggacaacaacagttcagaatcatcaactgtgacaacgagaagcatttagtgcgctaaattggtatacatgtgtgcatacatgtgtaatgtgtatgtactgtgaaatgaaaaatgcacatcatcaatatctttaaataagcctaat

SEQ ID NO: 75 - DNA, 2220 bp, Homo sapiens
gcaggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa

SEQ ID NO: 76 - protein, 435 aa, Homo sapiens
GDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 77 - DNA, 290547 bp, Homo sapiens
  misc_feature (1)...(290547): n = A,T,C or G
gacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttaatctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaagaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttgccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgcttgtttcctccctctgttgcattaaaacaactacaagatgaaaaacctatgtaaaccaaaaataaaattctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacaaaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagctatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatgatgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgctgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcttcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtggtgtgtgtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctctcccccaacgtgtagtcattttattccaaaggtttgtagttgcatggactgtaaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctatctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttaggcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcgatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttctgattgaaaaatatatttacataataccaatatataaaccattctttcagggtaagccaaacacatctaaaaattccattaagtccattggactggcagttattatattaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatattgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttgggttgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggtttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctggatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggtgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcaggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcagcataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtgcttgaacagttagggtagacttcattgctttggtaagactttcatgaacatggagtttataagtggaaagacaagaaatgtttttggtagaagaaattgcataagcaagcatgctgaggtataacttcaagtgcatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaagagaagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaaactttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcgttaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattctttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgggcagtcaagttgcacacacacactgttcagatgggtccttggaccatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgtttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattaatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccgtgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgtttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatataagttaattttctcacagttgtggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctactttttttccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcacaaagatatgttggattttatctaatactttttcagtatcgattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggctttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagtctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagcgtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgtttttttttaatagccattgaagactcagaacaatagggactccaatttgctacctgttcttgaaaatgacaatcagttacttaggaaagtaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaaaactgcctattctttctcacttcctctttaaatcaagtcatggtcttgtcctttcctacccatgaatgaaaccgaaggcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctactcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattaatatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtatgtgtgtgtgtttgtgtgcatttgtgttatagggtgaattgtaaccccttaagactcaaatattgaagccctacccccagtacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatacggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagccattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattccctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaaggccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttatcacactgaaacctacctgtgtgcacatctgtctctttcagttctttaaatggtatgagaacatgttaagattagctctataatgagtcatttctgcatccgtcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctaatctatctgtctatctatctatctatctatctaatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattggatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattagattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatctgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataataatttgtctaaacagagttctttcttcagtgtgctcttcacattttaatgctgatttgaagcctgtaaccattaaaattaaaatggaaagattatactttaagagtagaatcctcaaatgcatatagaagcataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtatatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcagttttctcttccctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccataattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcttctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaacatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctgtagattgctttgggtagtatgaacgttttaacaatattaattcttccaatccatgaacacggatatctatttgtttgtgccttgtttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagttttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggattttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggcaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagaccattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgtgttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaaaacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattgttatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagagggagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacggagggagggagggagggaaggagggagagagagagacagagagaaagagaaaggtctcttttcctcttttgtatattatcgaaggacatgatgcctgggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatattaaatattcatattagtgatgcatggggtaggaagtagtggggagcggtcctcctaataaggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttactttgaggaaaaaagaaattaacagtctcggattatgtatctcctttatacaaagctgctgtctgccaccaaacttattgggaatgaaatgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggaagaatcaggtcagacatggacttgaaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagtgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttgctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggtatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtatttaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctattgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtaccgtggtaattgccatagattattgaaatgaaaaatggctatgattactcctaacaacttgagatgttctgcttacagtggatgttaagaacatatcttaataatttaaaatttttcttaataggcataagcaagtttttattctttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatctccttctccttcctacgctgtggtaacaaccaatatgctatcttcttgagatccacatttttagctcccacatatgggtgagaacattcaatatttgtctttctgtgctggccttatttcacttaacatattgaccttcagttccatccatgttgctgcaaaagacggatttcattttttatgtctgaataatattccagtgatctgccagaactgaattttaaatggggttttaggcctggcattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtataggacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataacttctgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgtcttaatccaaaccaatgacaaatctcatctggacgattgtaattgcctcttaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatacttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatcagggaaatgcaaatcatgcccgcagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatggaaagtaatatgaaagatgttaaggatgttgtaacattatgccgtcaagtgggtggtgggttatgatggagaaccacaaaaccgtttttgtatttctgaacaaatgtactgcatacggggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacaataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 78 - DNA, 420 bp, Homo sapiens
aaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtga

SEQ ID NO: 79 - protein, 140 aa, Homo sapiens
  VARIANT (1)...(140): Xaa = Any Amino Acid
NSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGX

SEQ ID NO: 80 - DNA, 224112 bp, Mus musculus
  misc_feature (1)...(224112): n = A,T,C or G
aggcctttgtgtgttttgaagaccagttttgtcttcaaaagacccaggccagtatattccaggaaagcctagcatctacgaaatagtcaaagaagtttgtaggggagcaaaggttccccttaaaacaaggaaagcagattgaaagataaagtcaaactaaccagcctcatggatgtttaacaaaaggacagggatttcaaagatgcctggggtgaggtgcgattctttaaaaagaatctttagtggagaccaggatctccagaggaagtcccaaagggaggactggaaaggtgaaacagctttgggtaatctggaacaagtttaataacaaacttaaagctttttctctcataggaagcttgaaacccgtatctaacaaataatcaagtattttgtattttcaggaaagtgtcaattccagtgagtagaaaagaatgacagaaatagtcatttaaatttcctaagaccatagtttataatggggtttgtatttgaatgtaggtgtatttgtctccaaacataaagtgctttgttttgaatcattctataacaaactaaaatccagaaaatgaccagcagagtggcatatgaaacccataagaagcctgagaagaggggtatgcattaaggctttgttaccagaagtccttacgtttaaagcctgaacttcagcaacctcagtaaggtaggtatagcttcctaccaacgcaatattaaagatataagtaatcatgaaagcaggaaaaggtttaataaatgtggccacttagggaaaaggaacaaagtccagtgtctcccaggtgcatcttccaaatgtcagatctaaagaaaactatattgattaatatgttaaaattctgaacttttaaagacttgatataatgatagcaaatcaagagggaaagaaatctgaagcatttcttatactttaaatcactccctcagacctttgcaacgtgcgtttaatggaatttcctttgcacttgacaccaagatcctgacatgagttttagctttacacatagagcaagaggtatgctttaattcagcagttctggtcctgttgtaatcttattcagcactgagccttcatccttgtaggctccaggctgtcctgaaaggtgatctgataagttgtcagaactgtgtgaaatctcttcctgagagacaacttcctcttctggctagcaccaagcttcattcagttcttttccttctcccaatatgagatgcctggggaaattccattgcctttgagttcattgttttagtagactgatagtcaaagagagaagaacaaatgtccctctttagaatatccttgtttctgtttagatagcttcagattgcctaaactttgtaaatctggagaagagagatctactttgcaggaatgagtcctccatgaataaataattcactactgtgattaacttcattgctattacaatttacaaactcatatagacaaacaggcaagagtttaggttttaatattcctctaagagagagctatatcagggtcctgtcagcaaaatctttctggcatatgcaatagtgcctggatttggtagttgtatatgggtgcctggcaaatacagaagtggatgctcacagtcatctattggatggaacacagggcccctaatgaaggagctagagaaagtacccaaggagctaaaggggtctgcaaccctataggaggaacaacaatatgaactaaccagtaccccccagagctgtgtctctagttgcatatgtagcagaggatggcctagtcggccatcaatgggaggagaggccttggtcttgtgaagatcatatgccccagttcaggggaatgccagggccaggaagcaggagtgggtgggttggggatcagggcagggggagggtatggagggtatagggggcctttgggaatagcacttgaaatgtaaatgaagaaaatatctaatatatatatatatatatatatatatatgtatatatatttcctctagctattttctcaaaatgtattaggtcacatcaggacatcaggttaggagttggcatttctcttcccattgttaaccataatgtctggcacatagtaggctctagaaaacttttcactgaaggaaaaccagaacagtgaagggcaaagaacagtgtcagtcataagaaaacagaaaggaaaattagggaaaaatctattattaaactaagctttaagggaataagaacacagccataactagacacagaaggaaggctgaagatttgaagaaaaggaaaagataggcataaaaaataagcttggcaaattgagccaacatcagaaggatagctgggatgcaaacttgagttccatggtacaagaggagagggggtaggatggtactaaggggttccgtgatcatgatcctgtttgttttagaataagcaccatggcttttggagaggaaggctatcagcaaagggggtggagcagcagaagaggactgaagccagaacagctcagtttgtttgtagagactccagataagagatgataaaaagcctcaatcggagacagcactctaggctgtgcttttacctaattctgtcttttcttagatctgtgaacttggataaatcctaaatatcctgacatgagaatacttgccctagattacttcacaggatagcctggagccatttatgaaataatgagagaacactttgtaaactggaaacactgcaagatgtttgtcattgcactagacatggggaaaacaatgaggacaatattaaaacatgaccatggcagcagacagactctagaaacaagaggatcttctctgatatctccactttgctcatctatgtgccatttgtcaaaattgggactttagttttaattttcccctgacatagcaataaatagaggataattgtcagaggtgggatgagaatatgagactttctttgtagacagcgggttcccatgatctcatttaactttgcaaaggacaataatacctaaggagtaagacattatttccttttctggcggtgaaaaactaagtcacaggaaggtaaattaaatcatacaactaggaactgtggatagaggaagcatttagcaaaaccattttctatcatcttttagagatttcatcattgaacagagttttttaaaattatattattatcagtgtgtgtgtgtgtgtgtgtgtgtgtgtgtgtgtgatatgtgtagggagaacatacacatgttgatgtcagaggacaattttgtggagtgagttatcttcatcttaagtttgctctggggatcaaacttgtcacttactgagccttctcattgaacacagcattgttatttgtttcattaaatgatctatattggattagtaactttaagatatacaaagaaaaaacaatttctgcaggccagaaacttgtatattcactagaaagttatctactaaccacaaataacgtgtctggtagtgtcatagtcatttggagtaccaagttgaagaggtctgaaattatttcattaagaaaatgacatttgatgtaggtatggagggccaggaaagagttcatgggataggagcaaaggtataaatacagaggggcatatactagacatagatgacagcatacccaagagcaaagaaaggtaaggaagcatggtatgagagtggtggaaaatgtagttttagagtgtaggaaagagaaacacaaagccacaatcctggaaagatatgtgaagaaagaattgaaagtcttcaattttccaaaccaagcatgtgtgcattttcttatggaagaaatgggagatgaacagaggttttatacctagagataacatccttgaaattttttgttagtaaaactaacttttgtggcattatagaaattctaacaaatgtcttgaagtagaaacgtcagttcagaagctgtagatatagggtgagtgggtttagaatcaatggagtgtgtgtggatcgaagtatcagcctacagattcttgataatattggtagaagttgatgatattaactgggagagttgtgattgattctgtagtttgttcctgaaactgaatggatggtgaagaaagcaaaaagggaagaaaaaaaaaaaaaaggtttcacttgaagtatacagggaaagactagaaaaaaagttttttctttagacatactgtgtttggagcaaaagaagtaatagatggctttaggtgagtgtttatactaaactccaggcactggttttaagtgagagacaaggattaggaggcagttggaaatatagggttggagctcagagagacagcttcactgagaataaatctgtcacaattttaggacatgaacctatcaagattctaagttccctactaaagatgatgcttatcttgctcaccactggaatattagggctgaacacattaattccaataaaaaggtctctcaataaatacccactgagcgcataacatttttgaaatatcaaagaaccattgactaataagctacagtattctgaaaatcagaaaaaggatttcagtagaattaaaaaatgggaaactgaaagtaggaaagacagaatagagactggaatgcactcattttgcttggtagttaagcaggcattattagctggaagaaccccattcaaatggtgcagactcagtctggactgtaatacagaggagaataaaataaaagagaaatttgattcaattgcattgagaaggttatacttacagaagaaaattaaattatatatttttccatttctgggtttgattatggattttcatttgtctttaaaatgtaggagacatcaatacttggtataaaaaaaaaccctgtaggtcgagacctaccctgtagttatataaaatagactccatatttctttgtgtatgtgtactttttgttatgttttattttggtgctttatttatttatttgctcatttgttttgaggttgaggtttttttttgagagaaagataggaagaacatgaagttcagtaagtaaggaggtgtggcattggggggaaggggagggaatatgattagagtagattgtatggaaaatttttaaagaaaaactacatatacagacacctaaaaaataaaggaggaaggaattttatcaatttctttctcttaaaattatatatcttaacttactttttgatcatttcatacatgcctacaatgtggttttatcaaattcatccccatctcctcccttcctcctcttctcatactccatcaccacttcacccccaaacttcatggatccttctgtttctttaacctgctgagtccacttagcactaccggtatgcgggtgattgtagggccactggagcatgtaaaacctacagagggcagatccagaggaaaactgacacttcctcctgcagccaccaactgggctgctgaacattaaaacagcattcatcctttgatgcctgctataatgactgggccagtgacaatgtgaagaaccaacctgggcatgctttggaaagaaagaggctagcattacaatcaggtctttacttgaatatagatgacaagcatgttcttattctttattctcctcccctcccaaataagtgtcccattagtcttttaacttcctgtatactcggatgtattgaagacttttatgaatgtactcttgggtagagatagaatgagaaaaaagcataagaattcacaatactgtagggtacattttatctcctagacagtctaggatgagatttgtagttttgactagagttttctaatagtatacaatacatgaagataatttaaagcagtctttatcaaggaacataatgagcagaattatataggcaaaaaaaatttctagagcgtaggtagctatgttttttattttttaaaaaaattctgcatgccttgttgaatctacagcagacccttgtggacttgagcacttaactaaaggattcctggtgttttgcaatcctaggttctgtctcactaagtaaaacctagcagatagttcacctgaaaaacaaatgtaatggattttaacatttagcattccatttcttatattgaattgctttgcaaattcttataaagaaaatgctcaaaagtaactacataactctctctttaattgcttaccaatattcaattactggcaagttaattctcacagcatgaagatgctttctcataatgaagtataacagagcttttattgatgcattcataagctatttgcattggtatcactaaaagtacttctaattcaaatgcctacaaccatctgaaaagcagaagacagcacaaatacagagaatagacttgagttgagactagatgaaacagaatgcaaggacattgagaaaaaaaaatccccagtaatagtatcttctgaaaaagtattttgtgactcacctctttttctctttgtcataaaaaaaaaagactttccaataccaaagatgctgtgaacaagtaaagaagaccgaatacagcaattctggacttacagcaacagaataagtattgtcaatggacctcaaggttcattccattcttaccatggttattggcaaggctaccttgtagaacaatgagacaaaagtatacaacccagatctagagacccacttcaatgctcggaaagactgaaaactttcttctccaccataacaaatgaagatatggtatcctagaaatacatgtccatctacaattatcaaatgcttttcctttttagaaaaaaaaaggaacaaaaaaacaaccaaccaaccaaacaaacaaacaaacaaacaccaccagtcagagactgaaaaattaaagttttactatagtagtagtattaaaaacaacaacaacaacaacaacacaagacttctggacaaagaaatcaaaggctggcattttcaataaatacagtataaacctctgaagaaactcacatgtaagcttacatagtggaagaatagggtagaaaagtgaacaagaatctgagatcaatatttcttcattcaaagcttagcagacacatatttaagagctgaaattcagaggtaaagggtcacacaatttttgaattcagtcttccagtatttttctttgtttataagaaatcatttcacttccctgtttgtttgtttttccagactttatgttaggacaaagtgtattggtgaccttactgactgaaataagcatggctctaaaattgtatttaagacactttaaaagagccaatcagttaaaataattacaatccacaaaataaacaattcaaaatgtgtatttattgattgtattgtgacttggacttttataaagaggttgttttttaaacaatgtagtatttgaacctacaagctaagtttatttttgccagataactaactagctgaactggaaacatagcatatctgatcagttagtcacgtcacctttgtgaaattatcctactaattgcagtagatggttctctactttctgagttccattaaacttctcttagcccgaattcctttgcctggagtctctatgagttcatagataataccaaacagtctacaaaaggttaagttttagaaagcttatctgcatttctaagcattaaactttttgatgtatgaaaggacctacaaacaaattataaactttactttccatcttactgctgctacattcaaatctcagtcctttatactctctttccactctcaaactttatgcgtcaatccaccttcttacagttagggaaagctatgtttcttcagctttgcaggtctgcctattggtgcaaaaaagggcatcagaggccagtcacctgaaattgtcctgaagacattcacaaatgtgtgcaccttgcattgtctacctctaatttttgttctctaaacctacagggatgttttaggacaagaaaaatgctgagtccggagagcattaggctaatgttatacttgctattcctctccaggaaccccattaagtcctattagaaaggctccatttggtgcaaccctctgttacccccaacagaaacacaagaggaagagggggaaaaagggggtcttttgaagccttaccgattctgccagttctttggtcaagcataaggaaaccaggaacagccacaatctgaaaggagagggagggtgagaaacatgggctctctggactacagggtcctgagtgagaaagtgttcccccgggctcccttttgatgcctactcccactttttccgcagtgacagaagtgcaagtatagtcctggcttgggaaagcagtccaaagttggaaagaggagggggattctgagcagcagcagctcacccagggtgcatgcttgtggctgctccggagctgggtcccaggagactgctaagctgctccgcggcgcgggctcatctgggctccgttgatgcttggcagtttgttccttattcaggacagtgtggggaaggggggcgaagtggcttaatttggaagaaactaaaatcagccgctagaaaaaaaaagtgccccaaaggaaaacacacgcagtggtgcccgctacaacttctagcactcaggagatagttccatgagcccagggaggaaggaatggagggggacggggcggggctgcctgctgtcaatcacctccccctaccttgggaagctgcttctctttctcaatttcaagcacctctgcacataaccgttccaaagtttcatgcacaggtctctagagacctatacacaagaatctatgcaagtaggcattatatatttccataaagtaaaatagacttgggtgcactactactacataggcagatagtcctgaaagagaccttgcacaagggcccaagtgtgcagactcttattctaacttcctattttttcactaaacttttagaaagatgaggagggaatctctggagttgtaagcctaatctctaaacccagtaaaactgaggaggaattggtccttataaaacggattcaaaatataaagaatgcagtttatcccagactgagaatagaaatgttcagaagaattctttagcaaattcctgaaagacactccaaggagtccacatcgtgtatatttttggtcttttggttcttaaaagtgtctacaagttatcaaagcgatatgcatgcctacttcatctaggagacacaaattcaactactattgactccatatagacattttaaatgagatgcttgttttagttgtaaggaattatgctaatgttatataattgcttgccacaggtccttctgaaatagaatgatggcagccactaccttttaccttagcttgatataagtgacaaatattatttatggtactcaatacatgtaaatagaaacagtaagtaagttacaataacatttaaccttttaacattattaacctacttaatgcatcctatatggcatatgttgttacatacattaggtattcacaaatacatatgttcattgtcttactttatatacgtatatctaatattttctcattttctgtttgtatatagaaactgtcctaccaacacttgaaaggcaaaggccagcagcccatggagcagaggcgaaaactttgtttctaatgattaacaataaaaagcaccacactctgaaatccatccgctggaaaaaatagtcccagctcaggtctgtttgtcaatggctttgatgcagacatctgagggaaagctggactggcaggcaagagtactgttaagagaagctgccaatgaacaaacgagaaatctttttggttggacttgtggggttcagtcaacttgtcttgaagtttccctccctcaaataactgagcgtcactccctcgcaggttgccggtgcagtgggaagcactggcggagtgatacgcaaattccccagcgccagcggggagggggcggtgcagggaagagagcgaggaaagtagatttgtaggacgttgagtgaggaaagtttgcaagtcccaacagaaggcaaagtgctcctgagagatcggctttggggaggggagggggggagggtacactaccaagcctttgttgcaaggaccgtgatatagctgtcccttgtgtgactaggccggggnnnnnnnnnnnnnnnnnnnnctctctcttattttaatcgcttcccctcttataaatctcttcccccccaagtgcaccagcataaccgggacactcactgtcccctttctagctctcttctcaataacccttcaagattatgtcaatcggtctgaagggacctgggattccctgcgggtgctgacggagctgcgggagccagagaagaatgcaagtgcgtggagtgtgcctggctgccggctggttcttactggccctgtgtctgtgggggcagcccgcagaggctgcggtaagtcctccctcccgccccatcactgctcgctccaacagaaaccactggagcctttaccttccctactctttgaccttggccagggaagtcaaaattggctttaagtagaaagaaatataattcccaactctggtctgagggaaaattccaagtgtttaaaaacagggccgcttacttctctgtagctacctcttctggggcaagagtgggcagagggtgtgggaggcacattaatgggtcactgggctctggaggatatttaaaacttttcttcctctctatcccccacccagggtagctgtctaccagctagcttctttcactacttggacccagcccaagcacgatttaaccttggtttatagtttaaaatttggttcctctaaaattgaactgtggtcagtgtggtaatagccttgatggagttcttctcttggcatatgctcttttcttaagccacatgaacccaccccccaccccaggtttgtaaagttctgccctgttttctgacctgttgacatcattcttttacaaaagataaaataacctatcaaccaggacgaagtaaagaagcatacatagtcttatgcttcaggagttttgcacattaaaaaaaaaaagttatgggtttctgttggcttgcactttttaaactcataaaggcacctgaacaacttgagagtttgcctttcacccatttaaaggacaagaagtctcagttttccaatgggaatgagctctatgggttagaagagtgggggaggatgctcacacgaaatgacagagcaaaaagttccacttgcctttaggaatgtagactggataccacagcctgttcctgagcaggaaatctgggtagtcccaacacccactctccttctggagataagaggtaaatgcaaaggaatgaagggctttgctgcagaaaatattctccagtttgaagtctaccctacttaatttcatataaactgtgaacaactaaatgtgtgacaaattatttaagtattatatttgagtacacagaatggatgtttaaaaccacttaaatatggcatcatagcttaggccttcacatggtggagtgactatcaatcctttagacgcagctacaatattacagacatctgggtctacatcaaagttagcttccttttggactcagcacacctcagatcacattgccctctgtatatgctagaaaaactgtgtatactgctgttacaaaaagtaactttgatgttattgtaatcacaacataattatgatagaaaatctgtgggaaaacttgcacatctaaaatgttttagttatgcataccatcattttcctccatcaaagtagatatacgacttaataatgttcttttggtgcagagcatttttgatggggtatggtttccgcagtcaatatggctaaagatggttagaataaattataattgggctatagaaaatagttcatttgaagctcatcttagtgccttttgtttatagcatttgccctatgggcaaaaactttgtggatgacttctgaagcaatccttcctcttagttaccatttatacttgtgtgtataacaacactgcatgccagttgaaattcatttatattaaaaataagatttttttttattgacaaaacttatgtgcaagcttactttcgtattcttaaagtaacaagtgtttgtgaagtaattgggatttccccctcctatacagttttgaaaggactttttagttcacactttcctatggttagaattttgttcctcttttaaatctaggggtttgttgttccttcctcacaaataaatgccctagttaaatgaaagttttaatcatctcaaaaatatgaatggtatctgctctccatacttgtgctgggggtattggtcaccttctccagagtgaaacttggctgtacttggcttagtttttcaccaatgtcttctaatattgaggcttttatatcaggaagaacattacttcttaaattaatttactttttcatagttatatgactttactatctctggagtcatgccaaatttagataacaaaaatatgtgaactttctttttaaggtagaatgtttattaggtagaatacaataacccaggtattgaatggtcagcagcaagaaaacagggtaactttagtctgtaaggatcatttttagtgatagaaaaaaatcatatttttaaatgttaaggtgactatggctatacaaactctgtcaaagagataagcttgtagatttaatgatatgtctataaataatatggagaattatactacttctaccatacaaatgtttgtaagttatttttgtttttcttggaagttatagtattatttctacaatttaaaccatactgtgtaccttgtgaccatttataagaacttgtcaagggtaatagcaaggcttttggccattttttttctatgaaatgttctattctatagaaaaaatgctcatcttgctttcattattgtttgtgtttacattgttcagtgtttattatgtgctaagtactatgttaggatagtaagacaaattttgatatttagtcctttatgtgatgctagggattgaacccaaggttccaagtgtactgaatttgctctgtgatttgttttcttaagagagtactaatgtatttgtgtgtgtgtgtgtgtgtgtgtgtgtgtgcgcgcgcgcgcgcgcattaaaagctacttactagatgagaaaactataaaacagaggttaagcaacttgctaaaaatcacataggttgtgaatttcaaattcagagtttgcccctaagtcccttatattgtctcctttgcatgtaatctatagaattatgctatgttaacatatatatgaatctatattacatttttttagacacagaagatgcagtgttggtgataatggggtttgcttctattactgcttattttatgtaaagtagtatagcataatgtaaataaatttactttttaaagattaatttgatctctatgtctatgcagactgagatagtttaaatgcaatctaaaagcaatcacaggttaaatgattttatgtaatctcaataaaatttagatttataaaacacctacaacttctgatagatgatttttccatgaaaataattgacctatgtttcttttaagcttcctcagttagtttgaagtatgcagaaatgtccagaaatatgcctgttgtcataaataggaaatatatggtggtacagtcttgtcaaaaatgatcaattcactttgttgttttttactaactttcctacaccttcatatgttgttttgttcactcaaccatctatctatctttatatatatattattttgtagttttaataatcaaattcaggacattgcacccactatccgaaatctttacaatatacccccacccccagctctgtgtctacagtattatgtatatatttctgtatgtacccatcgtattatttttttaacagtgcataattttccgtgtttttacttgactcttgctgtttgcaagatatgatactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttcctttataaataagctgatcttattagactgtacagggtgatattgggagagagtctaggaagccaaataatctatatctcatgatagtttcttcagaaattctagcatctgttaatgtttctggcattagtgatgtgttgtagttaaattgtgccaaaggtgctttcaattttcaaaaaatttctacataaaatatcaaattttactataatacattttcactgttttaaatttactatataattatttattcgatatgtaacaaaaataaatattttctttatttttatttataataaattattattttattacaagtatttactgaaattattataaatatatacagacccaggagtctattcacagctgtttctatatccttcaatgtgtttccatcagctttgagcatttcctctattactagcatcataaaatggtcatctcctttccttcttctaatttaggaatgagccagttcaccaatgagtctattcttttaacaaaatagaggtatttagaaaccaaggtgtggatgcttggcatgctcattctgattgaactgtcattttatagcccttttcagcagacaagcctaggaaatgcatactatcttagttttatctataatcctatcacacacacacacacacacagagctgtaggcaatgtacctaaatggaacaatacatacatataaatatttgcttctgacatcaatctattagaagctttctatatgttggaaattataattcataacaatatctcaaattgtagttaaatatcactgaataaacacacatatttgctgtggtggggtctcttgttttgggggctttggggagagggtaagggagatgctgggaattgaaccccagaatcttgaacatgctaaacaagtccttctgcagttagctacaccctcatctacaacttgctaagtctgctccttcattctctacatggctttaaaggcatgtcatgatatttcctgtgattcagctttcttgtacattactttttacagtatactctttccattgtaccacatgaaaggttttctaaaacacactacaggatagatattttggttctctttcttgcttatcagcctttgctcagttctaacaaaatagcatgttacattttcagcagatgcatattgaactcctaataacaaaagagttgtatttatactgttctattcaggtaatatgcccacaacactatccctgcacacatctctctctctctctctctctctctctctctctctctctctttctctctctgttagacaattatcaataaaattaatacaatttcctgctttaatggagcgttcttgtttctccataataccacagcaattgatgattctacctttctttgaacaaatgtaatatttagcattttttagactagtctgtgcttgatcattttattttatagaattttttgttctctttattatattatcattatttggaggcaataattatatgctccctatttaaagagtttttgctgactgttttgtctatgacaagtgatatttgatcaacattgggaaactagaaaataagaaaaaatataatggaacaaagaaaaatctgactacaattctactagcagtctagaaataccttctattacctttggtgatttccccttttatagacatagtttttaaaaatagtttaagtatgggctcatactttgtgcaatttaattttagttttaagttacaaaatctttatcttagagtatgaaaagtctagtttaaaaacattaattttaagtagcttctataaatacaatttatatttctgcagaccacaatttatgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttgtaagatatatttttaaaattcaagattttcactattttaatcagttattccatgaacatttcttttttatttttatttattatatctaagtacactgtagttgtcttcagacacacaaggagaggtgtcagatctcattacagatggttgtgagccaccatgtggttactggaatttgaactcaggaacttcgggagagcagtcagcactcttaattgctgagccatctctccagccctccatgaacatttcttattttgtattttaatctctaactattactgcctctatcctgagtaattaatgtgttaaacacttttgctactttaattctttgaatcattaattagatgctaataatcaggaaacatatctacacataaactaggcaaacttttttagcaatgacatttgttaaggaaatagtgctatttttactttttaaaaattatattctctgaacactagaggaaggcagggggaccctgaatagcaagagtaggattctgggaggcagaggagaacacagcatacagaatcaactaacctgagctgatatgggctcacaaagactgaagtggcagtcatgggacctgcatggatttgtgctaggttccctctgcataaactctgtggttgcttagcttggggtttttataggattcccaaaagtgttgggggaggtgtctctgactctttgcctccccttgggacacttttcatcctaccgacttgccttctgaagccttaatttgaaaggttgtgcctagtcttattgcaatttgttatatcctattaggttgatagccctgggaggcctgctaattttttttctaaagatctaggggagagggtatattggaggggtggggggagtggaggtatgggaggtttcagtaaggatataacatatgtaaagtataacaataaaaataaaagcactacaacagcaaaatgttatatttatttataattgacacataaagcatatacataaatatactgctgtgtggtgttttaaaatgtctattcagtttccctatgtactttctgcaacctctggaaattactctttgattagcaaattctctgatcttatttatagactgtgtaggggagatttttagtatgtgtcttaatgtgccttacttttttcacataacataacaaattacattcctcccatgttgttgtaaggacctgtgtttgttcttttatatgaatggataatattcagtgtatatgtgcattgcttcttttttcattatctaggaatggacacttaggttcattgtattctgtattgtgaaccatgctgcagtgaccactgatgcatagatgtcacatacagatttaatttgcttctgttatatactcagtattgagactgccgaatcagataataggtctacttttaataattgaggaatgcccatacattccataatggctggtttaacttgcactctacccaacaatgttccacctgctgcccttttctctgtatcattgcaagaacttactgttttgcgcatgcatgcatacgtgcatgcgtgcgtgcataggtgcatgcttaggtgtgtgtgtgtgtatgtgtgtgtgtgtgtgtgtgtgtgtgtgtgtgtgtgtgtgtccgtgttcatgagcatgcatgcagaggataaaggagggccttgggtgccttctttattatctccatgtattttttgagacagggtctcttgctgaacctgaagttcaacttttgggtaaggctggtcactgtgtttcttgcatccttctgactacatttctcagtttgtgagttataggcatgcaaagtcattcttggcattttttgggtgcctaggatctgaaacaaggtccctgagctttcatagcaagcactcttatccactaggtcatatcccagctccccccccccttgtttctttttttttttattatgtattttcctcaattacatttccaatgctatcccaaaagtcccccacaccctcccccccgactcccctatccacccattcccattttttggccctggcgttcccctgtactggggcatataaagtttgcctgaccaatgggcctctctttccattgatggctgactaggccatcttttgatacatatgcagctagagtcaagagctctggggtactggttagttcataatgttgttccaccaatagggttgcagatctctttagctccttggatattttctctagctcctccattgggggccctgtgatccatccaatagttgactgtgagcatccacttctatgtttgctaggccccggcctagtcacacaagggacagctatatcacggtccttgcaacaaaggcttggtagtgtatgccatggtgtcattgtttggaggctaattatgggatggatccctggatatgacagtctctagatggtccatccttttgtctcagctccaaactttgtctctgtaactccttccatgggtgattgtttccaattctaagaaggagcaaagtgtccccaaaggtcgttcttcttcagtttcatgtgttttgcatcttataccttatatctcgctacaggatctcattctgtagcccaggctaacctcaagatcatgtgatattctcctttttgcccctcaagttcctggattacaaatatgctcaatttttatctgggttaattgattttgttctactgaattttagaactcattatatattctaaatattaaccacttgtgtgatatatccatgtaaattatcttgtctcactctgtatcgtatctatttattgtcatgattgtttcattcctatacctaaagattttggatgatataatgcttagtctttccttatgtgtgaatgtttatgtgagtcacacagaagtgaactgtccaaggtaagtttgtaaatgtgattaggacaaggtttaaagcgttctgggattatgatctgatcctaagattattccatacatgttaaaacagaggaatcaaagtatatcaaaaaaggtgggggtgtatttcattggttaggctgttaaattctctccaaccccccataattccagctccaggaatccaataccttctgtttacctttatcccttccataattcctccctatgattggccattttacttgtgtcatcatttaacaacattttattaaaactatctagggtatttattcacaaggacctagattcaaattctgcaaattttacattccctcagttttcttccttaagtgaaagagcccacccattttaaatggcactttctttttacctataataaggctattatgaatctcaatccacaaactgtctacctctcctagggaagttttgtgatgcatctggaatgtaaagcttttctaccttcctccctgactcttttcactactccaccattgaagcctagtaggtttttccttaagtagctgtgtatttgtctatttctttttctctctttcaccttaccttctgcactactccagaagcttcactctgttagtctatgttatccttgaggcaggaacagcagaattaaacttgtcaggatgtttggaacatgtggctctctatccattcgtaccattcctacttggttttctctctgtgttttctcaatacataaatggcttcattgcttgcctgccaactttgtagcttctacaattaaaatgtattcctctacaaagtcacaaactgttgtgtaattacttctccaggtggcatttaaataggtgaactttcagtgtctgaatgataggtatctgcttttgccaaattacttttcaaaatgattttaccaaataaacttctacccataatttataagagagcctaggagataatcttaagattattttctatctactacagggactatagagttgacgctcaatttacagccacttggttggttgatttggccctatcatctaatgattttctttttaaaatgtaatcattctatcatttcatccccttatttaacgtagcaaacacggattgaaagtcattttccaaaatatactcttgttaattaacattataaatgaatcacccagacacttagctaaatctttattacaaaattagtttgggatttttaagagaagaaaatcttaaggggtattggagagacatcttgactgtgatgtctgtcacataggctcctttaattttaggaatccagattctcattttatgcatgaatgcttgaggatatttaccttcataatttgtgcaggtccaattgtcctttattcctttagcagcttctgctggcctttaaccaaaaggcaggatggtgcctgccactttgttgaaatgggactcttgaatcccttgttatttgctaatggaagacaatcaaaggcaaattctacaaatgaagcaggtttctactataattaattctttaattgatcatttagtcacaaaaatctagcattggttacaaatggatatagagagcaaaccatcatttataaggaagtaataatctatttaatcaaattgcatttttcatagtgagtaattaaataagactaagcaattaaatcaaaatatttgaatattcctcctacaagtcaaagaattaggtttaattctagagttttttataatgtatataacatttagtcagatatttggagaaaagtggccttaagaaggagagactagggactggagaaatagctcaatggttaagaacactgatggctcttccagaggtcctgagttcaattcccagcagccacatggtggctcacaaccatctgtaaagggatctgatgccctcttctggtgtgtctgaagacagatacagtgtactcatataaataaaataaataaataaatcatttataaaaagaaaaagaagactctaaacagatacgtggtggtgaacatctttaaattccaatattcaggaggcagagacaggtggatctttcagaggccaccctatggctctctaagccaaggcccgagttgtcaaggtacaggcatgggcattttttaagtcaacttagcagcttatagacatggaaaagggttgcctgactatattttcattctctagccatagtctgttagtctcacactcttagtaaacgttggattctggaagagatactaaattttcataaattttatcatttaccactaatttaatattttaagcaagatcaaattattgtatgaatttgaagacatgagtagatataattttgtgagattaaaatgtactcacttgctaaacttttaataaatgccatttaccaaataatttttctcctaattgaatccacttttttttttttaaaagaggccagcctagtctatagggtaagttgtaggatagtcaggaatacacaaagaaactctatctcatggaccactccctaaaaaaaccctgagacatcatgaaaatttatgatatttcctatatattctctatttataagactattctttatttcttaaagaaagggaagtccttctcacagtctcactatttaataaatataatatgatttccttttgcatgcaagaaagatatattaatgcatttatatcagagtgctttctgattttagggttgaatgtttaaattttgtggatttattactcttttaaataagtcttctgtaaggatctactaatccttttccttttatgtatatgactgtatggtatatgactgtatgatgcatacatacacacatgtatatgttgttgttgttgttgggaaccaattattggtctctctgcaaaaacaatacatgctcttaaccaccgagtcatctctctagcactgtaaataagtcttttaaatgttactatgttttaattttaatatgatggtgttagttactgttttattgctgtgaaagacactgtgaccatcgcaagtcatataaaataaagcatttatatgaggccctctttacagttttagagggttagtccattagtccatgatcaccatggtggaaagcaaataggcttggtgatggaacagtagctgagggctttacatcctgatcaacagctaggagagagtggaggggaggggggcctggtttgggcctatccccagagacacagctcctccagcaaggtcaaatctcctctaacaaggccacacctcttaattcttcccaaacagttccacttactagggaccaatcatttaaatatatgagcctgatcctgggtgcagttctcattcaaactaccacaatggaaccaagtggtagaaatctttaatctagttattttaagatggcaagaaagtccagaaactacaacttttgtaatcatttgctctacagaaaacaactaaattattatacagagaacacaaagaggttggtgaaatatgatgctagtgccatgcagaggcagctgtggaagatgtctgttcagaaacttgtcctagctcacaacagtttagtgattagaaagctgtgaatgtaatcttgtaatcttatttatcttggtggcacagagccaataccagacagaaaatggaaatattgagttatgcttatcttttctgctactttcaatagaatttccaatcaaagagtttgttctccatgctgggtattaaaagaaacattctgattttataaagcatagcagaagtagctgttaggtgatcatagcaatttttaagttctaaggtggacaaaagtttatgaaaccagaattcttgtcttgcacaacatatagatgggtttcttatttataatttagtattagtagttgttaagtgagtgcatagtttgtctggggaaatatcaatttatttgaaatatgcccagaaaaaaaatgcccacctaaaaaaaaatcaatagattaacttacgggaactttcaatatcaaaacttttctaaaaaggcatttttgtatatgagacaagtccattaatcccaggaaagtaaaacacaaaatagctacctaacaactgcaccaaaactcaacttcatgtaccatttctctacaaattttatagtcatattaattcatggattttgtatttattctatagtaattttgtatatatctttccccttttatttattcttttctcacatattacatctatgcatgtcttatatgcactgtattaatttcatatctgcatgtatttgaatagtatgaatagtattcagtttttaattattaatgattaggaatacaatagatttttacctattgacctatttgctgtagttttggtgaaattaattttaacatattttatagggttttcatcattatgtgcatgattatgtcagctgtgaatcaatataaatttaccaaccctcccccacagccttaacaatagaacctaggactttatgcatcctagggaaggtccctaccattgatttccaaccttagctttctttatagtgttctccttttgcaactgcttttttctccctgattttattgtccatggtatggcctttataagaagttacctttcctaaggcttaaaacaaattttccacagctatccagctttttttatggcaaaagacaaatgtagaaggaattattggagcaaaatctgcttcagcattaagaatattatagagttatctgtgttgtatgaagaggttaaaggtcaatgttgggtgtctttttcaatagatctccatactatattttgacatagagtagatgggtggccagtaagaatatggctatgcctcgctccacatcaccagtgttgaggttacaggttcctgtcatcagacctgtgtttgacatgggtgctgaggatccccacttgtgcatcaagctttgcacccactcagccatttctctattctttgcatttacacttttaaacataaatcctttttatttgtacagtcttacagctagaagttgtcatcaatgtgtgaatgcttgtatgtatgtatgtatatacatatgtatgtatgtggatatgtgtgtatctatttctatttacacatctactcatacctatagtataagaattagctcaagaacagtgatcatattacatacttctatactttgcatcatctagcatacttacattaaattaatggaaaataaaaacttagggttaattacttttctcatactcaaagtatcatttttaactataggatagtgctatgtgctgtgatttttataaaaggagaagattgggatcattcacataatatagagaaacactgtatgctttaatttctttttatgcatttattattattattattattattattattattattattttatttattttacaatccagtcattgaccctcctggcttatttctatgaggaaaatgtatcctaacatttctttattttgacttagctttatcttgtagtgcttgaaaaatgtcctatgttaatatattttgagccagttgaagttaatatagcctcatgaagctttctacaataaaaaggtatatttcagctttgttatcttttctgagtagtttttctagctggctataaataagccagtttgttcagggtctataccaatggtaattttcagattttctttctctttttaaaataatacagtcatttccttttacatgagatttttaaaatttagctaaacagtctcctgccccatgttaaatcttttatcttgtaaatgtttatatacccattttgtgcattttctcattaacacaccatgcttattttctaaagacactttacaaacttcataagaagagagataatatatttctcccttcctgttctcaaaatcgagtgatcgttttgggttcaatgtctttgcttcagcaagtatattgaagttataggaatttggttaatggtaaaaagattcatccttaacagtaacttctctcaattctatttgcttgcttatcttttatagcctatttgggcattccatttttctctgcagttccagcagacttcttttttgttacagtacaaactcattagaccttatcactgtcttcatgctttcatttatgtctagagtataatgggaaaaccacaaagactaatgctggcaactaacaagtgatatcaaactgaaaaggtcaccatttttagaggctgaaataaaggttcatcctcagaggctcagatttgttatccagactaattgactgccatttttggatttgtagcatgacagtctttccattaaggatgttgtttgcattacctatacttcattatgcagagacagggaaaacagagacatggtattcctttagatgtgtgagtcattataatatgaaatctacaatcaatctactgaaaaataatggcagattcaaaattaggcattactgatttttgaggtactgtcaacattatactactcagggtatgttttaaaataagacctcaattgaattgggaaagactggaattttttagtggtaaaattgtattacaggctgtactctttcttagctttgcttgcatgtctacttttaaaatatatgtcatatgttcatattgtttagaacatatttttaaattataagagtgtttaaacatcaatagactggggaagtattacaagagacaatagtctcaatatagattctgacaaaatcagttaataatagaaatatacattcattagaactgtaacttggttgcttttaggtaaaatattatggcacttaaaattttagctccttttgtaaatttagaaagccatcacacacacacacacacacacacacacacacacacacacacacacacacgcacacacacatgcacatgcacacacacacacacccgtaatagattgacagtaaattttctatattatcttgtatctaagtttttttttaaattgttgtgacaaaaaatcgtgatccagtcaatttgtaaaacaaagagtttaatttgtggcttatggttttaagaccatcatgacagggaacttggcaataggtagtcaggcattgttcagaggctccagagatctaacttagagcttatatctgatccacaagcataaggcaggaagacagtttgggaaagctcaaaaaccacccctagnnnnnnnnnnnnnnnnnnnnnnnnnnnnnnnnacccctagtgatgcacctcctaatctttcccaaagaattccaccaactagagtaccaaacattctaataaatgagtctgggggggggcaacattctcattcaaacaaccacattccactccccatatgtctgtagctatatcatagtgaaagatgtgtttagaacaacttctaaagtcgcacctcatcatgaaacttctttaataagatagaaatcctgcgaaaataatggattcatataagtgggaaggagtttgctccagagtcttggctgaagcgtcttcaggtgttatgcgttctagctcaatgaacattttctgtgaagattgcgtgcatagaaacaatatttcttttatatggagtgattttatatttttagtgtaaagcagataaagaaggtttattccttttggtcaaactgagtagaggcacacagaggacaagtgaccacccaactccatcttttagctacgtggagatattttaaagaatgttaaagtaacaataaaccatgtttaaaatctaagtttgtactatattttacatttcctacataggaattgaattagaaaaccaattttttaaaacacatgttaacctccttgtgaaactcttatggcccatggttttatcttatgtctgcagatatggttgactattcatccctaaacaaggtatttttctatgcccttttaggcttagggaaatacagaacaggaaattaaaagaatttaagggctaaaaaccaggggaaagggctgctgaaaaaaaatgaacatcttctgaacaagacagaattataactatgcactcataatggcttcagatacacacagaataggaatgtcaatctaggtatacattgaagaaaggtttgcaagccctactactcatctctaaactagatcctggaagagggatagtcactgcctccagttgtgtatataccgaacttcagtagatagtccaaatccagttgttatataagctgccttggttaaagaaaatgggtcacagggaaaagaaaggagggaaaaaaatagaagtcaagagttaggaaagggaatgggtagagggaagagagaaggagtaggctatagcagggaggatggagggagaaagtcatttcaatgcaatatatacatacaagaaattgtcaaggaactaactagatgaaaggagggaaggagcaaagtttcttagcagtcctttgagatgaaactcaaaagccacccaaatggcatacatagctactgctatatttaaagcacagctttatatatagtgaaaagtcagcagccttgttcttggatatgcttttttctttcccgagagtctttacttctgttttcaagaaactccaacattgtatcatactgaccagtagtaaccccagttgatatcccttttgacagtatctctgggctgggtctcttgatgtaacacatctgactaaagacatttatttaaagtgaaacagaagaccaggtactgtggcttatgcctgtaatcccaggacttggcaggctgaggcaggaggattatcatgaatttatggtcagcctgtgttacatagtatattctatgccagtctaggctttgaagatttttgttttcgttttttaaattaaagggtagaaacatttaaaggatgacatgttttgacttctttctttccaatttgtatcccctagatctccttttgttgtcaaattgctctggctgggacttcaagtactatattgaataggtagggagagagtggacagccttgtctagtccctgattttagtgggattgcttcgaatttctcaccattttagtttgatggttggctactggtttgctgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctactggtttgctgtagattgcttttataatgtttaggtatgggccttgaattcctgatctttccatgactttttgcaaactttatatgccccagtacaggggaatgccagggccaagaaatgggagtaggtgggtaggggagcagggcaggaggggggtacagggaacttttgggatagcatttgaaatgtaaataaagaaaatatctaataaaaaatcaaaaaaaagggaaacagagctaaaaaaaatgacatgtactaataaaatactgatcctaaggttatgagtactttttgccattaaatgcattttctcttttaatagctattaatttttccataaaatattcttaaatattgattgcatttgattatgtgaatatttattgagtattgaattattatttgatatttctatatttttggacgttttgaaacagagctcactcatttgtatagtcttggatggcctgaaactcactctgtagactagtctagcctcaaaactcagagatctgcctaccttttgccccaaagttctgggattaaaagcatgtgccatgtaacctggcttagcttaggatttagacagtttactcattacttttgtctggaattgttttcatgacatcagtgtaactaaagggaaggaaaagtaggtttacaagcaatacaaagttttgttttttcaatcacgatttccagtaaataacagcagctttccaaaaggaagaattttaaacattttggattgagagcatttgtaatttgaaagagtcatggtcattttctagtagacacattaggatgggagcttagcagatgttaggccctgtgcttagttctagtcacaccccctcaatacaatatttattcaaagtgttgagccatattacctcctgcaacctttcctcatctcaggtatgaattatcaaggaaaataaaatttcaaagcaaacaaaccttgatgaatttagttgggaggcaattctataataaagctgaaaataagacctcagcatggccttttccagcactacaggatttccctataataattacctctttaaaaattaaaggagagagaagggttagaggatggtagacactaagacaggagttttccttattatacccattctcttagttacagtaagaatttttcaacacgtgctgtttaaagctaagtacaacaaaattttaaaggtttgaacaaagatctctattgtcaagaggatgtagatttttctcattgggtcttgaagtgtataggcaaacgcagctgggagaaatgagagtggcattccattagacatgccatgtacatgctctttgaggattctgcacgtctcttcgccattcctttgtcaggtactcataagggagtgtgggagggacttttggcttttccacattgctgccttcatctgtttgatcacagcaagctgttaggcttgactttattaatgaagcagagagggaatgctcagaagctatcttggataccaaagaatgagtaaatggatggacactctgctttagtagtttggtgttgtgcactaggcaggaaatagtcttgctctgcatggctgtccaaaatatatgaaagagctagctttgaagtttccagggcagtgtagtgtagtgatttagtttagagcattgatatcatacttgattttagttgtttctcctcttactaccaatgacactattattagtagattaagatatattaatgcccgacagagttaatatttcataaatgaaataactgacttcccatgggatatgtaataatttttcaaatgtaatttagatcaaattataatttttgtgtaatacatattaaaatattattagggttggtcttagacctagtttatttgtctccctttccagtccatttttgttttctatgacactttaccataggttgaaaagatggtgctaaaacaggtttttagtttatcttatgaatatttgttagtcactttgtgatttgtgtatatatcaatatttgatatatttaaaacacatgcacttttggaaaggtggtagcttattggaaatgaaatggctccaaaatagaaataggaaaacagggaaatgggaataattctaaagagaaaatcagaactaacatgtttgtatgcagctccattgagggagaactgttgaaagtactttctcgcaatttcttaggaaacgtttgtagactttacattactagattacttttggttaaactgagtgataataacagggaagctatgaatatctctgtgcatatatgttacgtttgtgttgattataccatcttacccaaagacaatttaagtaaatactttaaatatttcagtaaatacagcatggcatttagcaaattttaaggaaacaagtgaataacttagctattccaacaatgttttgcctccgcattccttggcacaaacagagacctcaatgaagcatccctcacgggagttgcctggggacatcttacagaaaaagcccaggtctcaattcagcctcctcctttattattttcttttgtaaaatcattattattggagtataatttacatatgttaaaacacaccaagtcttagtgaaaatgttagcgaattttgacaaacatgtttactcacagcatcagagtactgaccagtttcaacactctaaatagtcagactcgcagttttgcaaatcaaactctatctgtacactgggaaaatgttgaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaatgcaaaagaataaatttgctgggtcatataagaatatatttaccttataagtaacactagaagcatttgctgaagtgattgtattatattacatttccaccaacagtttatacatttttttaacttactgacttactgggtatgtaatgcaggacttacatagcatcaggatttttcctttttctttcttttctctctctttttccaactggatattttttatttacattccaaatgttatcctctttccaggtttcccctccacaaaccccctatcccatgccccctgcccctgcttctatgagggtgctcacccacacactcctacctccccgccctggcttttccctacactggggcatcaagccttcacagaaccaagggcctctcttcccattgatgcgctacaatgccatgctctgttacatatgcagctggagccacgggtccctctttagttggtggttgagtccctgggaactctgggggttctggttggttgatattgttcttcctatggggttccaataaccttcagctccttcagtctttcccctaactcttccattgaggtccttgtgctcagtctgatggttgactgcaagtatctgcttctgtatttgttaggctctggcagagcctctcaggagacagttttatcatgctcctgtcagcacgcacatcttggcatccacaatagtgtctggttttgatgtctgcatatgggatggatccccaggtggggcagtctctggatggtcttttcatcagtctctgctccacactttgtctctattttgttcccccttctaagaaggatggaagtatccacactttggtcttccttcttcttgagcttcatgtggtttgtgaaccgtatcttgggtattctgagcttctaggctaatatccacttatcagtgagtgcataccatgtgtgttcttttgtgattgggttacctcactcggcatgacattttctatttccatccatttgccaaaaattccataaatacatcgtttttaatagctgtactaatagtttttaatagtagtactccattgtgtaaatttaccacattttctgtatccattcctctgttgaaggacatctgggttctttccagcttctggctattataaataagatcagagtcacatcatgtagccccgcctggactagaacttgctgcataggctaagttggccttgaactcacagagatccacttgactctgcctctctagtgctgggattaaaggcctactccaccacaaccaactctcaatcaggatcttttatattatggctatcttggtaatggatatgaagtaattatcttggttttttaaattgcattttaatttttgttgatcttttcatgtggttattgaacattcaaatctttttgtcttgagacaaatatcctcttaaaatgttattaatattatagtaactgcgtgtatttgtgatgttaagaacaatttacatattgtcattgcatcttcttttttatttatgtttttatatgtacgtgtatgatccaaggatacccaaactattttgcctagtctgtggactatatttttttttcttaattgtatatttgaattagaagaacttaaattttttgatataatgtcaaatttatcatttaaaaatatttatcattgtttttacattatgtacaatactcctttaattattaaatgttgcttatttttattctacatatttaacttaatctctataattagtacttttgagccaatcagaattattttctgtacagtatgaaataaaggccctacttaactataaatatttttattttttcaaaatactatctgacatccgaaaagtacattgtgtccattttgtccttccccagcctcagaaacccctcagtcaccttgtgtaatgttagctttatccattctggatttttcatagagttagaatcatacattccaacctatacatctctttaccaacattttaaaactttttatggccattataattaaacagtatttaatgtttctttgttatagtttcacttttcattttgtaatctgtaaattttcacatgttttgtatgaatttgtccataatttttgtaacaatatctctattcaaagccttttttaaaaaatgggtcatatgtgctttttcttttgatttaaaagagaaatgtatatattctggatattagacaagttgattatttgcatatattttctcccatttcatagttgtcttgtcatttttgtgataatgtctctttattatattgtcttttttttttaagaaaatgtttcttttagcccatgcttgtcttgaactcactatttggacaaaactggccttgaattcctgtgtgttctatattgctgagttacaagtgttaactgccattcctggtcctaatgtcttttgatatgtaatttaaaatttttcttaacgcctatttttttattttgttgcttatacttttgatttcatacctaagccacatcaaaggcaatgacgatttggctctactttctcctaagagcgttctggatcccacgcataaatccaagtcattgctctatgttgtgaatgctgtggagtagaggttcagttttattattttgtgtatagatttctttttgcccagcactatttgttaatattatttccctattcaatactatcctcacttttgttagcaatcagtttatcataaatatgtgggcttcttactggattctcatcatcccagttccccacagtttggtgtacttatttctctacatttaaatttgtaatcaagaatcacaaatcatacaagatctttttctttttctagatagttttgagtctttgggtccctctacaattccatgtgacttgaagaatggcttttatgcggtttgaagattagcttaccatttgtgtaaaaaaaaagaaaaaaaagttgttgaaattttaacagtgttttcattgaatatatgaattgctttggatattggtgcaattcttaaaggcactaaatctttcgatctaagcactaaattattcaatgtaggagcatacactctctttccatttacttgggtcttttgaaattatttttctcaatgtttggtaggatttctgtgtctatgtcttttatcatttagattaaattttatccctgcataagttgcttaaattattttgtaagtgtaatttcaaaattttaacattattttatgtgtatgggtgttttgtctgcatatatctatctgtacactacatgtgtgcctgctgcttgtggaggccagaagttacagattgttttgagttaccatgtgtgtgcttgtacttgaacctgagtcctcttcagtagagactgccatatccagggatccaccccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgatctttgtgtcctttgacagttggattataatggagctctctggatctctttgaggttactctatgtagaaatttttgaatgtccatactcatatcctttagcatacaagtaaatctttttcatattatttcttcaaatgatttttttcctgaggcattatctttctctttttgttgcagactaccatcatgtgtatgctggactgtttaatggggtcatttaaaatgtctctagatcttctcaattttcatgtttttgttttaaacaggataattttgaatcttttatcttcaaatttgtgggtagtctcttctgctaactaatttttgacccctggattaaaattttcatttcaaatattgtgattttttttaacttattaactttctctttgattcaaggcaatgaaggtctacatatggtttctaaaaaaaataattctacaaatagagactctctcataaaactttctgtgttctttataagctttgttgatattttaattttctcttatactgctattgtggtttccactcaactttataatttagtacagaattttctttagttccttgaacaaaattaagatgcctatttcattgtttgtccagtttagccaatgtctcaatgttttcagaaatgaaagttcctgatttggccatagttctattttttcttgtacttttgtgttttttttttaattaacaaatagatgtttgactattttaactgggagtcaaatccttacactctactaatgttgttactgaatgctgcagttagccatttgtttaaactctttccaactatcttttgcaaagaccatctctatttctatgtcttttgttgaaatcagcattcatttgctggacttcagcttttatttttcttttgcaatgctgacactcaaatctaatgcctcacatgtgctagacaaacactgtaccaactcatagcttatgctagaacaatgtttttatatacagctccttgaaggaacagaatgacagaagaataatgaatgtttaaaatgaagaagtagcttctttttagagtattgattttgcttttgggtacttctttaacatctctaggcaatttgtgtagttatatgaagatcagttaaggtgaaagttttcaggagttttcttgtgtgcttagatttttaaatatctcagtaccccgggcatttttcattaccctaatatttaaaataagccttcttagctttcttgacctcgttttggtgctctatagtatatgtcttacctttaaattttacccaaggcaactgaatattgttctcttaaaaggtttccaaagatgcttactgttctttttatgagttaataaaaaaatcagtgttttgcatcagtcttttaagtaattctcacaggacttggaactgataatttagaatgaaagtttgtaatgctctttcaggaaataaggtaagggtccttaactacacacatggatgatctctttcagccacagagtcaagcgaagtagatgagtcaagggcaaacaaaaccaaaacatatgttctgtcaaagctgctgttggttagtgcttgattttctgtgtttctatggtgagatatgtgcctagtcttgcctagtccaccatttcactgatgttccaggtttttttttttttctagtttcaacatgcagttgttttgcactgctgttgttattgttctacttttgaaaagatggtagattatatatttaattgtatattggttttgttgctctttaacaaaccatgtatggatagcctcaatttctggaccctgtagccttattttgttgtttaatctctgtccttataccaatatcacactttcttgattgctataattttaaattaagatcgaagtaaagccagtgcaagtttatcttcattatgaaaacttccttgtttacatataaattccaggaattgtatcctaatttctgagaagttgcatgggattttgtatttgtcttataaataaattcacacatttcctgatcttcagtttgctgtttctttaagctttctagcaggttcttttatattttatgcactagttttcttatttattatcttataaattcttccggatttttttgttttgtttttttgtttgtttgttttttcgagacagggtttctctgtataaccctggctgtcctggaactcactttgtagaccaggctggcctcgaactcagaaatctgcttgcctctacctcccaaatgctgggattaaaggcatgtgccaccacacccggctttggaattttttttatttctatttgcacaattttaaaatgattggttttgaacaatcctttgaaatcttcattgaaagctcagtgcattagtattcagagatgagcctccaaaagatgattggacccataaggactgtaacttaatcagtagttcattccaaatttttagttcaaaccccaaaggatttaacagtcctaatggagtcatggcctatatggaggaagttgattactgatgacttcattttaaagggtgaagtcctttatcttgtactcaatgtctgccaatcccaattcacatcttgcttgctgtctggccaccataaggtgagtggcttctccactacatgtaccacactctctaccatgatattcttctctgctttaaactcttagcaattgaatcccccaatcgtgaatagatagaagcctgtgaaactatgggtccaaattaatctttcctgtttaatattaacttattttaatatgctttcattattttagaatatcatatatatgtacatgtattttgatcttatttattcctcactcctctctgtaactcctcccagactcactcctcatttactataaaacagttggacatatctggagatattctttactgttaaactgtctagtgagtacaggctagtgatgctgctgagcattctacaatgcccaccatggctaatcactcagtttctatgacaacgaatcaaccagcctgcaatactgcttctgtagctaaatactgcattaggtgtagggtttaaaaacatgtactgtttttaaatcttttatatgaatatgttgtatggagaatatatttgttctcatagcccaccattctttccttttatctttgatttttacaaatgcagactctatttatcaaatcataagcccagattagtaagcacttttctttgacaattgtctatcaccgagaaacagaactttgtgaaaaagcactacacacattttaccaaaaaacatttttacatgtttgaaaatttaataattttgagataccatgtattgatcaatgaaattttggaaatggtgagttctttataagacagtggtcacacctgtctctggagctcaggagttcatatcctaaaagaggagctagctatcaaatgatctttaagctgaaatttgatttattcatttatttaaaaaccttggatagttcagcagttaagaatactggcaaaaaacaaacaaacaaacaacaacaacaacaacaaaaacaaaaacactggctattcttccagaggactcaggtttaaaaacccttgccttatgaatgaaaatattgatcagaaggatatgtgacttattttctcctttttgacttatcctaaaatttctgtttgaaaattgagattacaatatatgtcagaacctcatggattctgattattagttatttttctcatttctgtgacaaatactgggcagaatgacttagaaggaggaaggactaatttgaggatgcaattaccaaggtagatggacagggcagagcagagaagatcatgcccaatgcatagaagctgtatcagagagtccttgtggttgctgcctttctccttttttcatttacttctcccaggtcccaaattagagcatagtgtctttcagattcaggactgctctcaatccttagtcaattctctcaggaacctgcctcattaaaccttctacattctacaggtattcttaactaattaatcttctaggtgcttctcaaatctatcaagctggcagtataaattaactatcacattatacaacgtagcactattctatgagatgaaatggcaacatttgtttatatgtgatatataatataaaacatattatatatgtatatgtatatgttagaatgtatggtactgaggggaaacttagggtcttacactaactgggtcaggctctacactaaactagagccccagccctttaaaaaagtcttggactatgattttactaaagtgctcagtctagcctggaacccactatagtatatgctgtcttttaatccatgttttttctgacctaacctccaaagcttaatttaattaattattgttacatgtatatatgtatatgtgtatacatacgtgtgtgtgtatgcagtcataaattcaacctgattagcctgtataataatacttatatgaatgtttttgcgacttagccaatcagtactataaaatatattcacattttacgtaaaatatgtctttaacatagtccagtggcccagcaagtgcaagtagatttgagtatattttaaaataaatttttacaactccatgtaaattatcatttggaggctgtgtttaaaattagacaaaaataaatccaagaatttcaatctgagacattacagtggcctctttttgttgaggaatgcttccaggagttggagagtaccaaagactaaccttggaaaatagctaagacatagaatggccaagtgagcatccatttctgtatttgccaggcactggcatagcctcatacaagacagctataacagggtcccttcagcaaaatctttccagcattgtgcaatagtgtctgggtttggtggctgattattgggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctcacagtcatctattgaatggaatacagggcccccaatgaaggagctagagaaatcacccaagaagctgaaggggtctgcaaccctataggtggaacaacaatatgaactaaccgtacccccggagttcgtgtctctagctgcatatgtatcaaaagatggcctagtcggccatcagtggaaagagaggcccattggacatgcaaactttatatgcctcagtacaggggaatgctagggcctagaagtgtgagtgggtgggtaagggagcagggcagagggaggttatagggaactttctggatagcatttgaaatgtatataaagaaaatactaataaacaaaattggtctttaaaaaaaaaggaaaaaaaaagaagaatggcaagtgaagggatgtaatgatggagaagatttgagagagaggctggattcctgaaacaaatcggagaacagggctgggctgcatttttgagactaagctgcccaacagagcttcatgtttggtaatgtggaaaagaattattactactttcttgaatatcttaccacaattgggctgtcaatcgttgggatttttctagtgaaagtagtgctattaatacccactattttattgtcttgggtttggttgctcaatttttccatgtgtattaaattctgagggctacatcaacagcacaaacttgttgacatgcttcccatgatggtcatagactctaaccctctgaaactatgagccccaaattcaatgttttcttctgtgagatgctttagtcatgatttcttgtcataagtaagacaatgatcattgtcaaagtaagacaacgacctcatctagcaataacacattttcaaacttttttctcagaataagagatcacaaataagtattcctggaaaaggagacatttactcaatggtgtaaatgaattatagtaccttttgtcctaagaaaatattttgttgttgtttgggttcctagtcacttccctgttgctgtgaagaaacaccataactgaggcaactcttaaaacagaaggcatttgatttgggcttaaaatttcagaggcttagcccattctcagcatggcagagagcattgcaatagagagcatggtagcaaggagcaatgcccgtaggcaggcagatatggtgctggagaagaaattgaaagctacatcctgatccacaggcagtgagagagaatgagtttggcctagccttttgagacttgcctttgcttgtggagtataagaattataactttgataaggggtaggagatagagataggaacatttttattttacattttagaggatgtttctactttatagtgcaaaagcaatttctatgtacatactgatatgagttttgttgttcctggttgatctttggcctagattttgcttgagaagaatgctagtaaccttgggaatctatggacttccattacacagagagattacaacttgggaaaagttcagaagttaagaagaaaaccaaaaacacaataatctcagaggaacaagaaagaatgtctacctttgttctgatcccctataatgtaggccaatgatggcctgaaagtagcagttgtgttgtagttacttctctggcctaccaaaatgcttgctttttgaataaattgtatttaaattaatcaaaaaagaaaaaggaaaaaaacagacatatgcatcacacagttctggaggtgcaaagtctgaagttgatggactggcagggctgttctttacctgattgctcctcttcctcacttctaatgatggtcagaaattcttatattatggtttctagccagtgagtctctcatcttggtggcattctacatgtgtgtatctctgatcaaattcctccattgtactcaggcctaaggccctgaatcaagtatgaattcatatgggttcattatatttacaaagactcttctttcgtttaaaataacattctgagatagtaaagagtacatgaactgggagacactatccaacttaatacataatatataagacttcttccttccttccttccttccttccttgctgtttttggcagtactgagaattaaactcaagccaaaagcgctttatatattctaaacttccatcagattctaatactacactcattgtacaattaacatagcacaatcaacaagtgaattaaaattccctataaatttcctttaaatatttgtttgcattgaatgggatatcagataatttgcaatggtttaaattatgtaagatatttatcttaaattttgttcctcattgatatatcatacttataaaatatattttatattacaagaaaaatagaattttccctcatttagaagtttaccaagtggccagaattcgcatagaatggtttaaagtcttgctatgtctcataatttttcccttcaatacctaagccatgttatagggaaggttaaaagttcaatgtgtatttaaatgtattcattgattcataaatgcctctatacttttttttacatcaagtaagaaattgttattatagctttgtctatggcactacagataacttccattacagcacttaacagagtcagtgacatttcatcattaattacttatgcgtctatctttctaactaaattgtgaaatcatagaggatgtaaataaattcctcttcagcactcattaaataaatgaacttggatacagcttttccataatcctaacaataaagaggcgaaagtagatagatacagtaaggccagcctaggctacatactgattttgaagccaaccttggtcatgtaacaaaacttcctcaaaaccagaacaaatccaaaaataaacaaggcaacccaatcacaaagggtactatgctacattattatatttaatataacattttcaaatgataacattttagaaagaagattagtgaattccgtagttgaggacagtatcaagatgcatgtttttaatgtggaaacctttagggttgtaactgcagtggcagccattgtaacacacatgcatgataaaattgaacataactaagacacagatgaaaatcagtacgaataaaattggtataatgtatgtaatatctatattcaacacatatcctagctatgagcatagtcaatcattttgcaagctattactcttggaggggaatgggaaatttgtattaggggtgtctacatcatttctcataactccctataaattcaaaagtttgctattataaaatgcttaccatttgaaaacatatttaatctgatacataaattggatttgattgtcaacagtgagcattttataaaataaaactcagtgtgctgacaaggctcacatccttattgttgggatttcaggaatgtgccactgtgtttccctagttttttttttccattttctaaaactgctgcattgcattccatattccatatgtattaatttgttaacttacatgttgaatgaaatttatgccaattccagtttggagctctttcaaatgcaagttctataaatattactgcaaaaatttttgtgtgaacatgttttctgtctttagtataaatgactagggctacaattgctgtttcctatgacagttacctatacaagtcataagaaactaccaacctactttaaggaatggcaatccctcattcccttcccaaattcaccttgtaatcctgaaatctccccaccattatcaacatgttatcctttcactacatagtgatgtttcagtgtgcttataacatgcagttccatggtagctaacaatattaattatttttatgtgttcatttgccacctgtatttccagttctatgaaattgccagtcagcgtttttccaccatttttaacctggtctgtctgtcctttgtactgtttgttgagaaatctttgtatatcttagatcccactactctgttggaactgtgatttgcagacaccttccctgagtgtataggctttataatctttaagtttataatcgttcatagaaagattttaaatatgatgaatacagcaaaatctaaatcaatactatttccttttgttgattttgtttgtggtgcaaattaagaactctctacctggtcctagatagtaaagatttccttctagattcagttttctacataatttacaattgtagtcctaagtctgtggtccattctgaattaatgtttttcacagattctattttttttttttggaatttagatcagcaaagtggccacactgagatcttttcatggtagatatctttaaaaaatttattattattattattattattattattattattattgttgttgttgttgttattgtttcaagacaggttttctctgggtagctgtggttgtcctggaagactgttgctctgtaaaccatgctggtcttgaagtcatggatctgtttttgcctcccacgtactgggattaaatacttgtattaccacaccaggctcaataaaatatttttcaaaaaggttgtcaccatgtgaagatgatgatcacaggggcatttgagaaggtgtgggaggcaggatcagtacttaacagagtaggtacaaaggccaactctggtgtgtgcatactcagcacttggtggcagacaggtagctgtgggccccaggctgaccacaggcagcatagctttcttgcaggcagtctccagagcttggaggttcctaggaacacatgccttaggatgaagagacaatgcccctgacaggaatgtgttccttccagggaggagcctttgggctgcaccattgggatgctatcgggctgcctgtgtggagatcttcttgccttgctgtgtacctactttcccccatggcttaacttttcactgttgtgcaatgtttttagttgttcatgtgttaagatgtattcacgcatgatgagtccagcaggagtggcaaagtaggtcctgagacccttctttaaatatctgaaacacactgggaaatactaaccccatcaacttgtcaacctctcagagcataatcaaaagattaaagcaaccaagaaaatacttgagggttaaaaataataataacagttgaatttcagttacagagatttgtaccattatatgtaccctgatttgtttgattctctgccctcaagcttgaaaagtctttgaagataacagtctgcattttactgtattcgtctgtttagtatagtttcccaggacaggagaaagtagaagtgaccttattattaaagaattctgtttttctcactttgagcagtgtagaagtctcctaaagggtcagcttacagggcatgttttggagaattcagaactctctgaagaatgaggtagtttagttgccttggtgcatttatgacaaatatttaagaataatacattatctactgttcttgggagtacgaaggatgccatttggacaaacaattttgaaaacgtgatatgaaagcccaagaaataatatagtttgaagaatcagggcaaagttgctcagaggagacctgcaatggcttgaaaccttctagttctgcatgacagatagtggtgtctaacttagtataggaaaatttttgtgtaagtaatgggactatacacatttaagaagacaacactgttttatgcattataggaagtctgtctccgatggttaatagctccccagtaacacaataaggaaagattttagtgaccacacataacatgaagtctagaatacaaaagaagcttagaaaagtcaccaaaaaagcagtaatgaccccaagcattgttaagaaatcctgtagatggatgtgaatgtgattttatatttactccactataatattaagaatgtactttcctttcttctaccttatagtcaagcactgcatgcccgtgctacatttgtagccaaaagtattctgtttttatagaaaagaggcacacacaaaaaggagaaaatgaatagtataaaaattaacataattttctcacaaggtggtccacaaatcctatttactacgaaatggcattatatcagcatggagagagtttgtatacaaagatctcagagaaactttcaggatgatctcatactcaaaagaactactcaagaactattcctgccaattagaggacctgcttgtaatgattttggacatatacccaggagtaacacgtcaggattgcaagataattccgctcttgctctttagaggagctgtcatactatttcatagctgtaccatttttatattccaaccaataatggataatggtttctagttttttctgcatccctggtcacattatgcttcttagagtagcgaatctcatgtctcaaatggtatcttctttgtgtctttgacatcatttcctcaatggttgttgacagtatctttttgagtgcatgctgattgttttctgtatgttctgtgaagaaatctacttgattcctttgttgacattttgtatatggggtctttctctatccaaaaaggccttaaaatcacaaccttcccaaccccacctcctgcatgctgtttattatatagttggattttttttacacattatcatctccttttctcacgctccctctcaccattacaatctccagcatcctttctactttcatgtcaaatgtatagtaaatgtacttggagaagtgatagatgagatcatttttatcttaattcagcccctttggggaggaattcaatctagtggcctggcatctgttttgcagtatcatatgctgccttttatttacatactccacttgatgaaccatgctgtttgtagagatcgtgagtcaatatatgtactgatttttcacttccattatgtttattaaaggagaatacatgaatacttcatgtacataggaactaaacagcagctcatgttttaaacccacttctttctaataaaaagatgttaaaacgaatggtgtctgtggaacttttgctgaggggggaagagagggataaatgaaactaagaatgtttggaaaagctataggaaaatattatttcatgttttcctaaaacaccacacacacacacacactttttggacatttatttggagtgaggatgtaattaaagacaaagggccttaatgtcataggatttgcttccttaaaatgacatacatgcaaaaacctttgcttcctctcggcaacataaagctgataccaaaaaaattaaaccctgaaagaacattgatctttgagttttaagccttcccaacagtgacataataaattaattttggttcagacagccagtctgtgatattttcttatgggaaacagaatgaactagcatgattgcagtgttagtaaaaatcaaacattccaaattacaaatttatgcacttcatattgagagcacaaaatagtgtagcttttaatattggcaagccagaataacatttttattaaagatatttgcttgttcctcatcctgtgagcatgacagattctttcctttgtgtaactatgcactcttacacctatgtgaatgggcttcagccagtattaactattcttatgactaaaacaaagtatcctttatctgtgtaactggagtgttgacaagtctttttataaagaagttatagtcttgacagagctttcttacttaggctctggatatcatggctttaggagataattcttatgtgttgtctttcattctgtgagttgtctcttctctttgtgaactgttttctttgctgtatagcagcttcttagatataatcccaattttctgtttttgcttttgttggtttctttggaactcatatccaagaagttattgtttatacttatacaatcttaggaaagtttttattacagttatctatttaatgtgtgagtggataccctgatgcacaggtagagtttcgaggtcaacttaacaggagttcattttcttcttccaccatgtgggtgatagagattaaattctagtcattagggttagaggaaagcgcccttacctgctgagccacttctctggcccttacactgatatttctaagtgttttcttttagtgtggtggttctcaaccttcccaatgctgtgacctttaatacatatccccatgttgtggtgacccgtaaccatacaattattttgttactacttcttaactgtacctttgatactgttatgaatcaaatataaatattgtgttttcccatggacttgggagactcccgtgtaaaggttgtttaaattcccaaaagagtcatgacccacaggctgagaaacacggtcctagaagtttccttctttaaacacatttatattattttctcaagaacttcatacatggtattttgagcatttttcaccttcatctcctcccatatgtacctttactccataaacacccaactttatgttaaaaaattttaaaacacattagtgctatctatatacttttaggtggatggtcatccaataaaatacattagacttgtcagggtctgcacccttgaagaaaactcactctttcttttctcccctggcatctatcaactaccaaaaattctttagctagggatgcagctttacagtcaagtcctccttccatgctgagattttctcttgctgcatgctgtcacacctgctgggaatttggatgcacaaatgtcctattgtgtcaggaaaacactgtttccttgtactcacccagggcccctggctcttattctcctacctcttctgcaataaaccttgatctttgggaggaagaggtgtgatacagatgtcccacttagggctgagcactctgcagtctccctattctctttactttgactagttatgggtctctgtgttaatttccatctattgcctaaaagagaagcttttctgatgaggtttcatatatatgcctagctatgggtacagcaaccagtcattattagttggtttattactatgtctcattaccagagtactagttgtaggtgctgcttcagggcttatgatttgtcaaactataggttcttgactctgataactatatctgtgactctgataactatatctgttatggcctctatcttgtggaacagaccttgaatctaatgagaaaatgatttggtacttctatgatattcttgctactgttataccaggaactgatgacatcagacaggttttcattatagcacacaaagttcacagttaggtagtattgatgaatacatttcttctcttacagaatgcatagtcccttccagcactatgaaatttagcctgtgggagtgaagcttcaaaaatttcctagtttaaagttgaaatctgttagaacctgtaggttatgataaatttttatttgattttttggtgccagttggtagatatgtgttatagatagctcttcttcatttgacggtccagtcttcctggcatcatctgctgaagagaatgtttcatctctagtctatttttggtgactttatcaataatctttttgttttcagtgacaagagccaccattaggagctggcatactagtttgatgtcttaccattaatttatatcccagctcatatgatgtgtcttgaaattagatactgtagtatttctaattttcatctttttatttcatatttgtttgaccatccgaggtctttttgattgtattgaacttacaaagtcatttgtgatatgataaacagcttaaattcttctggtgatgaatatacttttatatagtgtgcatgtgtcttcagtttgttatgttagtgttttgtaattttcattttagtcttttctgttcttagtaaattaatttctcattattttattttgtattgctttgaatggtactaatttcctaaaatgttgttattggtgcataaaatcctattgacttttgtttcttgactttaattttgtcaaatttctgaatttatcaattttaattgtatattaagagattttatatattaataggttttatatatcacactatgcataaatagggacaatttgattttctgcttcatgtttgcatgatcctaattccttttttcttgcttaattgctctggataaaacttccagttatatatgcaataacagtaatgagagtagacatcctcacttagttctagatatttatttatttgttctttagttcagactttattcccctccctgtctaccttccaactgttccccaatctcctcccctggtctccaagaggatgtccccactgcccctatcccaccccaccagaactccccactccctgggttcccaagggttaggtgcatcttctctgactgagtccacacctggcagtcctctggtgtatatgtgttgagggcctcataactgctgatgtatgctgcctggttggtggctcagtgtctgaaagatcctgggattccaggttagttgagactgctggtcttcttatggggtcaccctcctcctcagcttcttccagttttctcctatttcagctacagggtcagctgcttctgtccattggttgagtgtaaatatctgcatctgactctttcatctgcttgttgtccctttaagtttttcctaactcattatggagatttttttgttggtttgttgtatatatcttttattttgttgaggtataagcctagtacacttgattggtttggaattttccatcatgaaggaataataaggggcaatgtttagttttttttttttttgttgttgttgtttgttttgagaagatcttctctgaatagccctggctgtcctggaacatatcatgctataccagttgttaatgcaattaacagggttcactattttccccagcagcctacacagtaccttccactactatgaaatctagcaaccggggaggaaactttctggtcagtatcaaatttattttcccatgttctgtgaccaaacttcatgacttctgcaatatggtcttagcatcaagttatagtggctaacaacgggttatggcaatagtttagaaagcttgagagtctttgggacacctctggccaatagtccaaaggtaacatttccagacctgcaactgggctatttaattgataactccaattaaactctattatgtacacatattttaatttatatgtgtgtgaatttatccacattatatgtgtgtgtgtatgtatgtatgtatgtatgtatgtatgtatgtatatgtatggagcttataaaataagagttttccatatggcatttaaagacatccttggtgctaattattgtatggataaatggataatctcttgtgtactgtgtgaaagtaccatctatcaatgacctattagcaaaaggcagaaagtggaaggcgggtttgagatgttccggtagagagattggaactctggaagatagtaagaggtggaagattcaccacctggacactgaggaaattgaccatgtgaaactgggaagaagaaaccagtcgcagctgaactcagggtagaataagccattttattctaacctgagttcagctatgtgggttgaataaaaaaaaattaaaaagaataaaatgggttaataagttgagagtaagggaaccagccgaggcattttaaaaaaataaaattaagcctctgagtccttattcaggaactggggcgcgggtagaaaagcctatggttacaaattacctctcccctatgtcctcctctttcataccttcctatccctttccccactctaagccctctaccattattgcctttccttcccttcatatctgtcacctgtgttctaccatccttcctctctcaatctctgtttctgtgtcagctgaatatattgttttataccttttaattatgctcctgtctagtttaagtattaggaccatatgaggaatctacaaattttaacgaagtaaaacaatccaatttaaagataggcaaatgatgggaaggtgcatttctcaaaagaagagatacaagtatataaatgaaagatactcagtatcattatccacctgagaaatacaaatgaaaaacaatgtgctacaattttacctactcagccttcagtcctggatatacaacttgttttgtttgttttggtcagtttatacatagtaaatattttccctatatctgacatgcctactcagcatattaaagatgatatatgttgaattcaattttgaatttttgataaaatcttatttaatattttatttatatctgttctttgtcttatctaacttggtttaagcccaaattataagaatgtttattagatattttcttcatttacatttcaaatgctatccccaaagccccctatgttagttcatgaagtttgcttattttttatttaaacattgtgggcttcagttatagttttttaatcattggtctattccaaattaggtatgaggtaaagaccgaatcttattttgtacataggggcatccagctgttctagcaacatttgaaatatcttttccctcttgattgttttgacagttttatttaaaactagccataggccatctcacttctgttttctttctttctttctttttcttcttcttcttcttcttcttcttcttcttcttcttcttcttcttcttcttcttcttcttcttcttcttcttcttcttctccttcttcttcttcttcttcttcttcttcttcttcttcttcttcttcttcttcttcttcattttccttttctttttcttttctttggttaacattatgatattgccacactatacctttaaggcagtggctctcaacctttctaatacagttcctcatgtcgtggtgaccacaaccataacactatcttcatggctacttcataactgtaatttttctactgttgtgagtttcaatgtaaacatctgataggcagggtttctgatatgcaactcctgtgaaaggcttatgtgaccttccaaaagggaagtgacccacaggctgagaaccagtgtttgttgtggcaaaattttgaccaccctaaagttaacatgcaaaatatctaataaagaaaagcaaacttttaacaaattataataaattctagtttcctgataagaattatgattcacctggagtactttcttcaataacctatccactataatttcctgaatgtcattactatcaactgaggacatatttttaataattgagcataactattggtaaatttgaacctaactttggttaacattgcctgggattcaaaaattgtctcaggcatgcaggataactgcactagttttacacgtaactctaggagtagacaatagaagaaaattggagaatagaataatattaagaaacctaaccagggaatttagacattttaggattcccttatggttcgtggacaggatgttagggagtatatcagactgaattttaattttgttcactgtcttagttagggttttactgctgtgaacagacaccatgaccaaggcaagtctcataaaaaaaaccaacgtttaattggggctggcttacaggttcattatcaccaaggcgggagcatgacagcatccaggcaggcatggcacaggcagagctgagagttctatgtcttcatccaaaggctgctagtgaaagactgacttcctggcaactggggtgagagtcttaagcccacacccacagtgacacacctactccaaccaggtcacacctctaaatggtgccactacctgttccaagaatatacaaaccatcacattcactatttcatatgtaaaaatatcatgtatgcgcttggtgagaattctagtcactgcatttctgttttccggatatactattatcttattaaccttgttgtttggttgtttctgtattccttgtaagtcatctctttttaataatagcaaaatgttttctggttgtattctattgtttattactttccatatttactaacatttcagcaacatttataaataatgttcatatagcttgacatttaatttattagaatctaaaattatgaatatttgagctgttgcattgtctatgcttagatacggaactggttcttgttctcaaacgtctgaaggccacattttttgttatggataaatttcaagaaatgttattcaaatgccgggtcaaccaagtctctgttctttttgtttttcttagcagttttcccagatttgactccttttaaattttgatttttagtttctttcaggtttatgatcctccctgtgcattctttattttgattctgcctgtcttcatttccaaattccatgtttttacaagttttaaaatcaaatttagtctgggttctctgatctagctctactttagctgtgtgcaaattttctttcacattgagttatcatgttcgcatgatggattgttccttgtttttaaaatttatttgtttgtttgttttacttattcactttacatcctactcactgccccctcctgcacccccctcccacactcctttccctttcttctctgaacatgtggtagctcccttgaatattcctccccaccctggcacaacaagtctctgcaaggctaggtgcttcctctcccactgaggccagagaaatcagccgagctagaagaacatatcttacatacaggccacagcttttgggaaagccccgttccagttgttcaggacccactgcagatctgctacatatgtgcaggaggcctagttccagcctgtgtatgtcctttggttggtgattcagtctctgagagccccaggggtacaagatagttgattctgttggtcttcccgtggagttcctatccctttaggagctgcaatccttcctcctatttttccataagagtccacaagctttatccgctgtttggctgtgggtttatgtctgtctgtgtcacttgacaggtcaggcctctcagaggacaataacgttggtgcttgcccatgggttggtgcttgcccataggttggtgcttgcccatggggtggttctcagatgaggtggttattgattggctgcaaccccagtctctgttccatactcaatccctaaatttcttgtagacaggttaaattttgggtcgaaagttttgtgggtggtttggtaactatctcgtcaccagggttcccacctggccacgggaggcaggctcttccggttccatattcctaattctatgaggcacagctaagggctcctctattgattcttggatgcctcccaatcccaggtctccgtctcttcctagagatgtaccccacctctatcccagcctcttggagatttccattcattctcatagccacacagccatgttccttgccacctcccattctcctcccaaccacctccctacccacttccctccctacatctgccttccacatccattccattcccccttccaagtgaggctcaagcatcctttcttgtgccctccctcctgtccagcttctttgggtctgtggagtatagtatgggtatcctgtattttatgactaatatcaatttataagtgagtacatatggtgtgtgtcctttagggactgggttacctcacttaagatgatattttcaagttccataaattaacctgcaaaattcatgatctttgtagttgaataatataacattgtataaatgtaccacgttttctttatctattattgagttcagggacatctaggttgtttctagttcttgggcattacaaataaagctgctatgaacacagttaagcaagtggctttgtgggatggtggaatttcatttgagtatatgcccagaagtgatatagctgagtcttcaggtagaactatgccaagttttctgagaaactgccaaattgattcccaaagtgatttttacaagtttgaattcctaccagcaatagagatgtgtttttctccatagtcttgcccacatgtgctagctcttgaatttttgatcttaggcattctgactggtgtgaggtggaatctcagagttgttttgattttcatttacctgatgtctaaggacatttaacatttttttaagtgtttctcggccattgaggattcttctgttataaattctctttaactctgtaccccattttcaaattgggtcatttggattttttgaaggttagcttcttgagttctttatgtattttggatataagccctctatcagtgtcgcgcccgctctcgaccagcaagaatgacgcgaccaccagtccttctaacagcagtttattcagtcctgattcttcttgtttatatctcccccgaaccctgggcctctcactccttttatactctctctcatccacgcaccgcaggccacgccccctcgccagtcacgaggcttcagctaatcagggcagcaggggcaaatctccaccaaattggattcacctgtatcctggtacacctgcgcagcacttaagatgtttgtgtcttatatgaggaagtcaggtgcaagtcatatgacttagctgcagtccctggcgcctttgggactgccgccacacccgctccccacatatcagatgtgaggttagtgaagattgcttttctcaatctgtaggttgctgactatgcctgttaattgtgtcttttgccttacagaaacttttcagtttcatggggtcccatttatcagttgatgattttagagcctgattcattggagttatgtgccagtgagttcaaggctctttctcactttcttttctattacattcagtctatttggttttatgtggtggtccttgatccacttggacttgagctttgtgcaaggtgaaaaaatatggatctattttcatttttctacatacaaatggccacttagaccagcatgatttattgaagatgctatcatttttctattgtatgtttttggcttctttgtcaaaaatcaattgtccataggtgtgtgggtttatttttaggtcttcaattctattccattgatcaacatgtctgtttctgtaccaataccatgagggtttgttgttgttgttgttactgttttaatcctattgctctgtagtacagcttgaggccaggaatggtgattcccagaacctcttttattatggattggttttgctatcgtaggtttttttttccatatgaaattgagaattgctctttccgtgtctgtaaagaactctgttggaatattgatggggattgcattgaatctgtagattgtttttcgtaggatgaccatttttaatatattaatcctaccaatcaatgagcatgggatatctttccatcctcagaggtcttctaagatttctttttttcattgatttaaagttcttgtcatacagatgttttacttgcttgataagagttacaccaagttattttatattttctgtgactattgtgaagggtgttgtttccctattgattcatttttcctataaggaactctacaaccctatctttcatattcatttgccaatcatctccttctcatctgtgcacaccggtctcatttataatgaaaactatgggatttttttcatcacaattgtataaaatgacaatagattttgaagagtatatagacaaatttttctttggaaatacttgtcccctatgactgatgagtatggacaaagtactgtcaattttaataggaaatagctagttttctaattactgaattgatcctatataggacatatatatatatatatatatacatatatatatatatatatatatatatataaagaatataagtgggtttttgtatttgcattggtttgtgagcatgttataacattttccatacttcatagttgtgttttgtaattagtaatgcagttacatactttaaaataccttgccttttccttttggccacaaaggaaacaagcagcattgaagcgttcttgcactggatgaatatgtcaaaccagtgtttctgtgatttctgcttcttagaaaccacaaaatcaggatattttgtgtagaacacttgtctgaacgaatggcatagcaaaatttaagatcacattaattcattggactatgagtaccagttgctgagattatcagccaacaattccattaaaaatattcttgcccattcataagggaaaaaacaatttctcctttctctcttcctgtaaataggcaacaaggaggcccagagcatgttagtggattttaacactggtatagaaccttggatttggactcactagatcttaaatgcacttagaacacagaatttgattgcttcataggagacattcagacatatttatgttttgcacaactctgaagtttttcttcttataatcatgattctgtggtctttttgcttgctgctttttttttttctatgatgttagtactttttcaaggccaggtgtcttatggttctctaaaggaagagaactggtagactaaatatctctcagttagaatgggacttataagtctatggtttgagtagtccaacaacagctgtcagaaatgccaagaatccggcagttgttcagtacataggactggatgtcttagcagtcccattcagatgttagagtcctgcaatattcctagagatctgttggtcttcacactctatttcaatccctactaagtagattctcatgcctgccaaagagtgccccaggaacaagatttaaacttgccagggaaaacaatggcaggcaagcaaaaatcaaaaccttacttcttttatttctttttatgtgtgctgccactagaaggtgtggcccagatttaatggggggtcttcttgcctcacataatctaattaagaaaatctcttatgggcatgcctggcagcttgggtctgagtatactccagatttagttaagttgacaaccaaaattgaacattacaagtccacctcttgttaacttgacatacaatcatatcccttatctcatgcttgaattccaataaccaagtcataattatatctaacaagctataactacctcacatgtagccccaaatgtgttaggtattttagaataggttacagtgtcactggaggaatgcttagtcttttaggggtctttttcagactgtttcttagagactccttcttaaagcagcaaggaagcagagagacagatcctagcatataggtttctttacgctttttaatgcatccaggatcttagccagtggaataatgttcctgacatacccagaagtttgtctccttggtgattctagatcctgttaagttaataatcaatattaacaatcacaataatctataaacacatcagaccattatattactccattaatctaagatttacacattagttaaaaataaataaatttatacctggggtttgtaacacaagcatatgtagcccagctactctagaagctggcactctctaggatgaactggagagcattgcagtagtaaacaaaaactactggtgatgtagttctgtgatagagctcttccctaacacatctgagctcccagtactgaggacactgagaatggaggattgtgactttgccagcaatgtggaaaaaattagtgagttccaggttcagccaaattctatgccaaaattctatcatcaaaaaatattaattaatttctatgtgttttattatatatgtatgagtgctttgcctctgtgtgtgtgtgtgtgtgtgtgtgtgtgtgtgtgtacaccatatgtgtacctggcatcaatggaagtcagataagagtattatagtccctaggactgtagttatggatggttgtgagtgctgggacccaaaactgggtcatggacaaaagttgttaaccactgagaaacctctccagtcacctctccaaataaaattttaaattacattagacatattccaagctaaaaatactggaagatagtcactaaaatatgaagctttcctgaatcagttctaaattaattaatgtggagtatatgatgatagtcaccattttaatctctgtaaaacaaccttagaacccataagagactttttcaaacttcttttatttttagaatttaagtttcatttttttaattattaagtttaatttactactactgtaatttggctggagaatgaacctagagtttcatgagtgataagatctctctctctctctctctctctctctctcttctatatatatatatatatatatatatattatcttaagtcagaagagtagttgttaaaaatgcaccttatgattataatatacaaaaataagccagatgtgaaggtgcatgtctataattcctttacttggaaggtgaaggcagaaggttcaggaattcaaagttattatcatgtacacagaaaattcgaggctagcctaagctctatgaaatgtctttaaaaaattagtgacaaaatataaactaccctaaccaagaccaatctttcactcctaagtttgatgcagtgatgaatataaattagacaaggtaattttcatatttatagaaaatcaatttttccaacccaattactttagaaatgccatttcacataaggtctatctagaagtactcatgaataaagatattgcctaaggactggacagatatctcagtgagtacccagcttcagtttctcacactcatatcaggcaacttacaacttcctataactacagttccaagagatcagcagctccctctggtatatgttagcaccacatgcatgggatatacatacatgcaagtacttatataaagaaaataaaatttaaaaataaatcattttagagtttggaaaaaaaatgaaaaaaaaaaacccctatctgatgcaaggcatagacttagctttcttgcaccaaatgtaaggttactggaagtaatcagagaaacttagctgtggttttagaagattacagtattagtagtgaggttactggtaaattttccagagaaaatgctagaaatgccatcatttgttaattgatgttgtcaaatatttgggctcactttgatcaatgtgagtttatggtcatcccgcgtctgccatccttctgtaacctcccttctgtttgcaatgctacccactcctccatggaatacacaacagcaaccaagttcctaacacagagagaaatatgcattattcttctattatcacaatctatttcaaagtattacaaagaaaacaaatagtattagtaagttatatgctatgattgtgaattacttgtaggcatcaagttttaattttacatgtgtgcacattatcgagtttgtgtatataatgtgttgctttctatctctctgtctgtctctgtctccctccctccctctctccctccctctctcccttcnnnnnnnnnnnnnnnnnnnnccctgcctctctctcctattctgcacacaccagcctagctggccttgtgagcctcgaggaattctcctgtctctagctcccatcttgctgaagaagcattgggaagtcagatacacactactgcactgataagtggtgaggctttgacctcagttcctcacatctgtacaggggtgcccagtaagcagcctcccctgcttctctataatattttagagaaccacttaatattttttaactctgaatatggagcaactggcaggtgctgttttggttaaaaggctttccaactgattaatgtgttcagcaataatttgatttttaaagaaaacttccattatagcgagaagaaaatgtttccccttcagagaaaatctggcaaaatgtcttggcttttgctcagaatttgtaagcaaatgagaatcaatttgaaatattggagaagtcaagggagtgattctggctctgcctctgttactgatgggctctgaattttctcacatttaaagtgataggagcacattagttaatttataaaatccattacaactcttctaacacttttattgtaagcatttattatgaagagatgtgatgtgtttatggcttgtgataggatatcatgcaaagttgtacaaaactattcaactatgagttcaacaagcactttaacagttgttcttccagtggagattttgtgttgtgctgtgatgttcaagatgatcttctacaggaactaggttcagttcccagcatccatatggcaacttacaaccatggtctatacaactccctcttctggcttccataggcaccaggcacacacatggtacagatagagacaaatacccacatacacataataaaatataaaactaaactaaaataatgtcttctaatagtgtcttaaacacacaagaagagccattacatattggaatgacatagatattgggtacctgtggccccaaaatttaacttgtactgaaaatcatcagtcctcttcgtcatcacattagaattcctcaatcagtaaaataatgtgcaaatatttttatcaacacctatgttccattgttcttctaatattataccatttccaggtaaatcagtaagttgtgttttcatattttgagtatgtgaatgttattgatatgctatttcttgtaattgtaggccttttgatatagttaccagctactgcatttatccatgcagtgcatttattaagccatctttatttcaacaagtgctatagtgtatatattttcctcacttttttcctacactttttagagtagaagactaaatactaaagtgtctgtgtaagcaggctctttgttattttctggcttataaaatctaatttgtgtcaacatattaacgtatactcagcaactttattaaattattttctgatgaaattcttttgaattttctatccctagggtcatttaatctgtgtgacatttgtgggtttttttccaaaatttcttttcatttcaaaaattgctagtacttatgttaaataaaacttcatcacatattatgtagtatgcatatatacatttacatatatacttcttgatttaaaaaaacagtctgatatttatccttcatattcagtcctatgtatctgttttctggcattgtttggttagatttgaatcctttccttaagttcaatagaattatactgaaatattatgttgtatatgatctttagactatagtatatggtcacttttaataaatatctgggatttaactcataagttgggcttcttcatttaatgggtacattcattatatcatcaatgtccattagtataagtttgttagtcatgttcaaatattcatatgtccttacaggttttttgtttgtgtgttatactggttatgagaggtttgtttaacaactacatagatttgtgtacctttatcaatctgttggtttttactttatatatcttggagatattattagtgtgcataatttaaagtattttaaacagaatctttcttgtgaccaaatcttttttcattgcagtgaccttgttttatcttttgtaatgtgttttgccttaaaatccattttgtctaaaattaatgtagtggtaccagctttctttggtgattattgtgcctagcttcttcttttatttcaacctttctatgtaatcttaggcttttgatgtctctgataaacatcatatcatacattctgaaatttgcttccttttttgaaattctaaggatatttgtttccaacattttcctcagtggtcttacctaagattttactagcattttcaaacatagtaagaatatgtaataaaaacaattatatcttcatctagactcagtatttttctgtgtttgctttacacatctgtctcttgctgcctagtgtttctatgtgtgtgcaatgattgtttaaaagtaatttacagacagtaaaacaccatatacctaaaaacctcaccacaaattgtcttatattagcctaataaaatatcacccttaataaaattaataattttaaaggcacatgtctgttatagttgtttatatcctgcttttgttcattttcttgaaattccaaatgtcaagatgatgtttgaagaaaatattccatgggcatctaatgtacatcttcagaggtgaggggctatcctctcagtaaactttattttcaaggatgttttaggaaaaaaaaaagacttgagaacttatgatagctattgtactttgcaagaaaaagccagataagttgacttatcactgtactaaaaacatgatctcaagaaatacagagttgctacccattatgagatgtggaagctctgtgaatacccaacttctcttcagcaacagcaagccatgtaacctatataaggttcattttgcatgtttagcatcaccctgaggaaatgggagcttattgaagcccaggatatgggcctacattcttatgacctattcagaagtctcatatttttagaaacatctcataaccttggggtaagcccactaagttttcaagtaaagaaatgtcttaatattttttagttgttgacaagatgaccttcctatattttatttctttacttggattttaaatagcatctttgatatataatttacacagtattcagtttgtctattcaaagcatatgttcagtagttgtatagaatatgtatatagaattttacaactataccccaaattatttttggaccttttttatccatatgttaagaaaaccacatcccttagctttttcttcccattgacatcagccacaagcaactgtcagtctgcttgttcatataattcaatatattctcaacatttaatagcagtaagtgaatgccagcataatattttgtatttgtgggttttttttacttaatacaatatttcaaaagcttatggatgtggtagcatgaaacaatacttccctcctcttttttgtcaaatgatatttcattgaatatatatactacagtttatttaattagttcatcttgatgtatatctggatgttttctcacatttggaatattatttgtaatcatgttttgtaatttgtaatgtagacatacataagaggttttacagacatatttttaattttcttagatatatgcctaaggatggaatagtttgctcaatgtgtttaattgttttagtaagtgctagactgctctaaagtggctatattgttctgcaactctaccagtgatgtatgagggttctattctcagtgatgttaatattctctgtctttttaaactagaaagagctagtatgtatgaatttgtatttcatcatatttttggttttcatttccctcatgcatggctaataacattgagtatgtttgcacatgctttctgcatacatctctttaaaataaataattattcacatttcttgcctgttttaaaattgaagtacttgacttcataatgttatgagggctatatatatgcatatgtatatgtatgtatgtatgtatgtatgtgtatacaatatatgtatgaatatataatactatatatttataaatcatatttctcataaatgatatataaatataccctcataattgatatgtgtgtttaccctattaagtattttcacttttcaattctgattattttcaaattaaaaaaataatttaatttatactctcactgcagtctcccttcacgcctttgccctcatctgttcatcttccctttctcctcagaaaaggggaggcctcctatttatattaaccagtcttggcatatcaagttgcagtaagactaagttcatcttctcttattaaagctagacgaggcagtccaggattatgcaaagggtcccaaatgtgggcacagagtcagagacagctccttttaggaatcccacatgaagaccaagttacacatatgtgcagaagacctaagagagagtcctaagaactcgctggttgacagtttggtctctgtgagcccctatggttccaggttagttgattctatgtgttttcatgtggtgtctttgacccctctggctcctacaatcctttttagctctcttctgcaagatttcccaagctctgcataatgtttgttggtctcttcatcagtttccataaagctgctgggtgaagcctctcagatgacagctaagttggggctgattttaatagtgtgagaggtaggctctctctcatgcatgggtctcaagttgggccctcaatttctccttcaactttaaccctgcatatcttgtaggcagaaaaattgtaagtggaaggttttgtgggtgtgttggtggcccaatccccccacatgcaaagtcttgcctgattacaggagatgaccaatttaggcttcatattccccactgatagaattcttagctaaggtcaccatcacagattcatgagagtttctattgcactaggtttgtagctcttcccagagatgcctcccggattccagttgtttcttccagtaccctctctctctgtcctctcctcacctgcttctttctgttcctatctccaccccatccaatcttctgttcacctaagttgtctattctatttctcatttcagtgagattcaagtgttcctccttgagctctccttgttacttagattctttgtgtcagtggagtgatgcaattttcaacaaatatctgcttaggagtacataccaagtttgtctatctgggtctgggttaattcactcagaatgatctttgacatttttgttatgataattttaaagtctttaaacagatttgcattatgtttattcatgtgtgtgtatctgtagtgtgtgattgaatggcatgtgcacatgggtgtctatgggggctagaagagattgtagatctccctgcaggtgaacttacaggtggctgtgagcttttgacgtgggtgctggcatctacactgcctctctgcaaaagctgcaagcatacttaactgctagccacctctctggccctttttgtgatttttcaaagagggactgattaaacagatgtcaggaatatggacttcagtgcttccttttcatctttttataattttaacttctcaatatgttacccattttaagaaaaaatactttaaaatccacaaggagacataaaagaccaaggatagccaacacaatcctgatcaaaataaaaaaaaaagatatgtagaccaaatagaaagaaattgaaaaactaaatgtaagtacttcatattcagccactttatatttgaaagagatgccaaaaatataacctggaggaaagaaaatatcttcaacaaattgtgatgtgaaaactagatgtccttgaatataaagggagtagggaggaatatatggagcagttcagaaggagaaagagggagggaggaatgcaataattaagttacaatctaaaacattacaaataaagttgtactcttcaaaaaacatggatgtccacatgcagaataaaattagacccttatttatcatcatactccaaagctaactccaagtggatcaacagaccacagtgtggaacctggaacagtgaaacagcttgaagaaaacagaagcttctgtatatgacatacacataggaaaggactttctgaataaggtttcatttacccacaatttaaagccaacaaatgacaaatggaatttctgcgtggctaaagaaacaatcaaccagaggaacaacaatatgaaccaaccagtatgcccagagctccctgggactaaaccaccaatcaaagaaaacacatggtgggactcatggctccagctgcatatatggcagagcatggcctagtaggtcatcaatgggaggagaggcccttggtcctgtgaaggctctaggccctagtataggggaatgccagggccaggaagcaggaatgggtgggttggggagcagggggaggggggaggggaaaccaggaaaggggataacatttgaaatttaaataaagaaaatatctaataaaaaaaagtgagagaaaaaggaagcctacagaatgggagagactcttgccagctgtgcatctgacagagattcaatattcagaatatacaaaaaccaaagagtgtaaatgaacaaacagacaaacccaaatgaccctttcaaatgatggacctggaaagacagggatctcaaaagaagaaagaaaaatggcaaataaacagctttaaaatgttcattgtacctaaccactgggaaaatgtttgtcaaatgaactttgagatttttctcttacccaagtcagaatggcaaagatcaacaaaacaactaccaacaaatagtgttggtggtgttgagaactggtttagccacttgaactcaatgtggacaattctcaaaaagctaaaaataaatctatcctatgactcaggcataccactccttggcatgtggtcaaatgactcaacatctcattccacagataatagttaggccatgtttatttctgctctattcaaagtatctagaaaataaaaaccacctaaagtacccttcacccaaagaatggctaatgaaaatatagtatatttgcactgtgaaacactattcagttgttaatgaataaagtgaaattacaattttcccataaatagatagaattagaaaagactgtactaaatgagatgacacaaagctagaaagactaatgtcatatgttctatgtcatctgaggttctttttttaaaatttattttttattagatattttcttcatttccattttccagatattaagatgtgagtaaacaatctcagtttctctttttctaatgtttaaaaattatggtttgagtgaagagtgactctcagaggctctaatatttggacacctggctcccagtcagcagcactgcttgggagggtgttgaaggtataaagaaaggtacttcatttacacttgtgtacttttaagatgcttcattatgtataaacacatatttcaatttacaaaagatgacaatgcccaaaatacttcaagcaatattctgatcagttttattttcacattttaacttctaaaattatttctatacttatcctatacctactaagtaattaattatttcgagcaataaatttttgagcagttccatactgctttaattattatagttttaagctatgttttaatgtggtataatatacactttgttcatttttctttaattttttctatattttctctcaggataaaaaagaaaaaaatctacagattcataattatcatgcattaacaaacttctatgattttgtagaaataaactttcccccataatactgaagcaatcaaactaggtcttgagagacagaagcaagagttgtacaagttacatgttagtctgagacataactctgcctcagaaagaagccaataaacacgacttgttgattgtacttttcatgtagacttaggaattcttttcaactgagatacataatatttattttatctcactattggtctcatctaaatttgtctttaactgtatggcttggtgtagtagttattttttttcctttagaaatcttttctgcctattctttcgagtgctatgaataatttttagactcaagggaattgtctttcttaactataataatcattgataccagtcattttcttttacttggtaaatcctatagaactctagttaaagcttaatctaccacgggagatcatattatccctatctgtcataaatgagaaacaaaccctagagtgtatagacaacatatccatgatctcataatgaatcagttgctacagaaagatcaagatatatttcttgtatgttattagtttttattttaattactgctatagcattattccacttaatttaaatttcattttcatttgtttacagctggatcagcaagcacccaggtctgcatagtttttatatcactcatagattcactattgtgctttgtgcttactagatattttgtcaatatgagtagatgctgcctaaaaattaaaagctgttccatctaatgagatatatacttaggaccacctcttacggctactcattaataacttcatgaaaagtgccatctaatggttggtgtgttacaatgacttggcttttttggtgtgtccccgccctcttcccccgccccaaaaatgaataacacaatcttatttaaaaaaataacctatctggcataaacagattataacttaaaattttaaattaaattcaatcaaaatttttataattcttaaataatgaatatttaattttattttatgtccattattgtgactccaggaaatggagttgcagacagttgtgaattgccatgtggggtttgggaattgaatatgggtcctctggaagggcagccagtggtcttaaccagtgaggcatctatctatccctatattcttaaatacttttaggggtttttctctctaaagtatacttcacgtttgttcataatgaactttgatatgatgaaagattaattttgagaaacattggatataaggaatgctacaagtatataaaatgtgttatttgtttatacattttatttttaagatttaggggttattgttagatattgagaagtgcaaatacatgtgtgatgggagttcatattatttttaattgtattaataaaattctattagtcgtctttgcactatattcggaatggtaatcccttttcagaggaaaatttattataaatgtctgaaaatgcaaaggatgttattttttaatttataacaaaatctcctctgcatatcttcttaattaaaatgtagatacacttaccaatgtcaaatattgttacattattatccattgtaaataataattacccttagttcttcaattaatttttttttttgagtgttcacaatatgtacaatttaattcagatattatgactgttgactattcttttttgttgctgggtttttggttttgttctttgagacagggtttctctttataaccctagctgtcgaattagtgaatgtgtggctactaaattttgtaaattcatagtttataaccaataactcatctctgcatatgccacaattacatattttaagttgacctctgttcctaaactgagtattttatatgagtatatttatattggtatgcttgtgcctaacaagtcttcttgacttcaataataacccttctcatttgatgaatgactgtgtgtcaacaaacctataatgtggctaaacatgtaatactgaaaacaataaaatctatgtccctaatgtgtactagttacgactgcataactatctagtttgcttcctattattgtgctaaagtccattaccaaaagcaaattggagaggagaggggttgttttgctttcatgccccaatcactgtcaatcagcccgttactgagaaaagtccaggcagcaagtcaaggcaggaacctggaggcaggaactgaaatagaggtcatggaggagtgatgcttattagtttgttcttctggcttgctcagcttgctttcttatacaactcatgactacctgcccagacatgacatttctcacagtgggctgggccctcccaaataaatcactttgggggagaatgccccacaggggtcattttctcaactgagtcttcctttccaaatgactctagcatgtgtcaagtatataaaaaaaacatatccaacacaataacagactttaagctgaagtgtcagattgtgcttttactggaacacactcctttataaccaggaaaacaggtttcaacaagatggtggcatctagtttgagctgaagttaaataatatttagggagattctccagtaataactagaggaagacaagataggaggctagcttacatggtaaactacaggtgctaaagatgaaacaatgattaacagagttttatattttccttgtacaaaactttcagaagccagtttgacaaaatgtgttcaggtttgttgtgcataaatgctgtgttgtttgcatatgttattctaattcctcttgggttgttttgtcctaagcattccagctctatagtagtgtatgttttggggattagaatgtcccttactatcttcccagtctctatgtgtttttatagtagagaatgatacttttctggctccagaacattattccctagtgtggttgaattcagagcctctagcctgaagcttggaatggttaagaattgagctattagtgatgaaagagcaggcacatagggaaaagggagataaaatacagtattagatgctttatgatccacttgtgaatgctgagaagtaagctgacatcaagtggcagttattcttggctagtttccatggtcatgtgctgctacagactgcgaagtgattcattacaaatggaagaagaagaagaagaagaagaagaagaagaagaagaagaagaagaagaagaagaagaagaagaagaagaaggaagaggaggaggtggaggaggagaaggagaaggagagaggaggaggagagaggaggagnnnnnnnnnnnnnnnnnnnnnnnnnnnnnnnnnnnnnnnnnnnnnagaaggagaaggagaaggagaaggagaaggagaaggagaaggagaaggagaaggagaaggagaaggagaagaaggagaagaagaagaagaagaagaagaagaagaagaagaagaagaagaagaagaagaagaagaagaagaagaagaagaagaaggggaaaaaaggtgttcttacaacctggacaagtggcaaagcatatgaacgagaacgtcttatgaattctcttttcagtttagcatctttaaaatgttatttcttagctggacatggtggcacacacctttagtcccagcactccaggggcatgggcatgggcatgggcaggggcaggggcaggggcaggggcaggggcaggggcaggggcaggggcaggggcatctctgtgagtgcaactccatactgagttcctggatggccagaaactggatagtagagacactcttgtcttaagaaaacaaaagcaaaaaggtatttctcagcatgtaaaggagatgtctacaaaacccagcaacttgatttttattgcttcatgttgttttccaaataccacacatattctacagcatgtgtgcaacacacacacacacacacacacacacacacatgcatgagcacacacacacagaataaataaatgtaaaaatgaagagatacttattagtttagaattataagcttttatttgctcattgtgagaaattgaaagaaatacatataacaagatattgaatataaaaagccattgttggttgcatgcatcctttcatagttttcttatattgattttgcaagtgtgaattactgccttaagttgatttttaagttggagagttgctgttaagtttgtatttaatgattttcccctttatttcctataggcctgccatgggtgttcttctggatcaaaatgtgactgcagtggtataaaaggagaaaaggtaagttctgagtaaaaaaaatagatatatcaaatactatttgtaaattaattgtacaaattatgcttctatcagtgtccaaataaataaaatagattctactgcattgcttaatttagagtgggaacttacatagatgagactgtgtcaggatcagcaaacatctcgatgaaacatgatatcataaatattttaggtttagtaaacataagttcggttacattttattttctgttggggattggatccagggctttgcaaaatctaagcaagcagtctacaactgtgccacattcctagggggggttctcagaaaattggacatggtactaccggaggatcccacaatacctctactgggcatatatccagaagatgttccaaccggtaagaaggacacatgctctactatgttcatagcagccttatttataatagccagaagctggaaagaacccagatgcccctcaacagaggaatggatacaaaaaatgtggtacatttacacaatggagtactactcagctattaaaaaagaatgaatttatgaaattcctaggcaaagggttggacctggagggcattatcctgagtgaggtaacccaattacaaaagaactcaaatgatatgtactcactgataagtagatattatcccaaaaacttagaatacccaatatataagttacaatttgcaaaacacatgaaactcaagaagaacgaagaccaaagtgtggacactttgccccttcttagaattgggaacaaaacacccatgggaggagttacagaggcaaagtttggagctgagccgaaaggatggaccatctagagactgccataatcgggggtccatcccataatcagcctccaaacacagacaccgttgcatacgctagtaagattttgctgaaagtaccatgatatagctgtctcttgtgagactatgctggggcctagcaaacacagaagtggatgctcacattcagctaatggatggaacacagggcccccaatggaggagctagagaaagtacccaaggagctaaaggggtctgcaaccctataggtggaacaacattatgaactaaccagtaccccccagagctcatgtctctagctgcatatgtatcagaagatggcctagtcggccatcactggaaagagaggcccattggacttgcaaactttatatgcctcagtacaggggagcgccagggccaaaaagtgggaatgggtgagtaggggagtgggtgggagggtatggaggacttttgggatagcattggaaatgtaaatgagtaaaatacataattaaaaaaaacacaaaaggacaataaagcctcagaaactactgagaattcttaggatgcacctagggaaaggacaaggaaatgggcagggaatgggaagcagagattggggagaatgaacaaaattaattatggataaaagtcctctcgaaacatctattactttacaaataaatcattttcttctgtcttgttttagatagggtcttctttgtaaccctggctggctttgagctcactatgtagaccttgagcttacacagaacaacctgcctctgtctcccaagtactgagattcaaagtgtgagccatcatctccagccttacaggaattttaataacaataataataataataataataataataaatttctagctcttggtctagacaaaatacacctcagatgacatttaacttgatggcttttatcttccagtgccttatttgtctgtgtgtcagtaactgacatcaaattaagaatttcaaacaagatcatgaattatagacaggagaattatgagaaagggatcttacattactctttcctctttttaactcaataaatatttttaatgaataaacaactattaataactatatatgaagttatggatcatatctttagtgaatattccagttagatatagaagtattcattcgtgcagtaaaagatgctaaaaagtcctggtgtcaacaatttcatcaatttatgttatgtattcattgtatgctgtgatcttatttacaagttccattctgtcatgtaacacagtacccctgtactggctaatttgtgtcaacttgacacaggctggagttatcaaacagagaaaggatcttcagttggggagatgccaccacaagatccaactctaaggcattttctcaattagtgatcaggtgggaaaggccccttgtgggtgggacgatccctggactggtagtcctttttttgttgttgttttgattttgtttcttttttttaatttctttttttaattaggtattttcttcatttacatttccaatgctatcccaaaagtgccccataccctcctcccctccactcccctacccactcactcccacttcttggccctggcgttcccctgtactgaggcatataaagtttgcaggatcaatgggcctctctttccactgatggccaactaggctatcttctgatacatatgcagctagagacacgagctccggggggtactggttaggtagtcttgagtactataagaggaggctgagcaagccaggggaagcaagccagtaagaaacatccttccatggcctctgcatcagctcctgctttctgacatgcttgagttccagtcctgacttccttggtgatgaacagcagtgtggaagtgtaagccgaataaaccctttcctccccaacttgcttcttggtcatgatgttttgtccaggaatagaaaccctgactaagacaatcccctaacagaacatctcttaagagttcttgaatagtagtctagataacacttgtgtgagtaacatttttaggggaatatctttgcaacaagaatgctttctgtagtgttaaagtattaaagaggtttcatttgagatcacaaaggaggaaagaaagtggaagggaatgtcttttaaagaaaggaagcacacatggagaatttacatgtatgtagatattattgcttatacttctcagtctgcaagatgatggatgggtaaattcttaccaagagtcatagttatggtcacaatgacctacagaaaatggttcaagactccagagtgcctggaaaagaaggaaggcatgttggaatgaatataagacagcacagagtggaggacaaaaaataaagttgaagattccattcaaattcttggttaagttttgattttatatgtattgagggaaagtcacagaatctaataaaaagaagagtagaggcttaaaataactaagtatagattaaccattgtttggtgaacggataaaactccatttaatcaatcagtcacgaactacttcatacaaaaaaaaaatgctctttagaagaaaataagagaatctagtatctctttctacagtatgcaattaaagcttaccaagtaaacacaaccaataattttaaaaaaagacaaatcacagaaaattattaaaacaatacagatgctacattttggaacttgaagcagataaagttaatatatttattaatttaaaaggaaaacctgttcaaaattgataaacatgtagtaaccacagatcactggcaaatacatgaaaaagaaacttgaaatttgaaaaataaaaagcagtttatccaaggagtatgatagcaaactgttggcttggagctgctgacaaatgcagatttccaggctccacaactgtaagttacccatctcgttctggtcatggtggaaaataattgattttgacaaactctccacgtggctcttttacaagctgaagtctcagatctatatagcttcattttgacagtagctaaaattcttctaattatagtgtggcaactgtctcattgtggtacagaattataaagagaaaataagaattatacagaacaatatattattgttttaatttcttcactaagaacttagccttgaacttgcacaatttgcaacattctaactgaaaataatttataactagttaccaatataacactttgtcttaattttttcctatgtccacacacaattgtgtttcttgacagttctacattatccttcttgaagtactattctcatgcttcctggagtaatatacaactggcatactagcactcaggcagcataagcaagatgactagaagttcaaggccaacttacatgagacactcaagaaacgaacaaacaactatttttatgctcattttcaggaaacacttttattgtttattataaacagctcttcttgaaaggggtgctatcttaaagtacttttaaactccagatcttaggtaatcagtagattaatcttctttaaactggtgagctgggatgtgcccaagggtagaatacttggctttgtattatatctgggactgtagatttgatatctatcaccacacaataaataaactagacttatcatgagatagtttttctttggataatttatcaaaacctgaaatattgcctttattctgggtttaagtaaaagcactcactagaaaataaggatgtcatttataaatggattttttgtttattttattagatattttctttatttacatttcaaatgttatcccctttcttagtttcccctccgaaaataccctatccctttcccccttcccctgctccccaacccatccactcctgcttcctggcccaggcattcccttataccgggtcatagaaccttcacaggaccaagggcctctcctctcattgatgaccaactaggccatcctcggctacatatgcagctagagccatgagtccctctgtgtggtttctttgactggtggtttagtccgagggagctctgggggtactgattagttcatattggagctagagaaaatgcccaaggagctgaaggggtttgcagtcccataggaggaggaataatataaatgggtttctattgaatatttgttctattggacactaaaaatacaacattgaaaaagccatgactgtttccatgtagaggcgaaggagatggtggtgtccaggttaacataaacttctgactgagacagatgagctgtgttctatgtatcaagtttacacttaggaaaattataaaacttctctctcatgacttttcacacataaaatgaaaataataattttactttgtcttaaaatggggagaaaaaagtaagataaaacaaaaccctgaaggaggttaaacagtctggaaaacagaaaaacattcaacacacgtgggctatttttacagtctttcgagttttaagtgtttggggaaatgcttaagaaagttgctaataagaacttaccattactattttcaattgtccagggaaaaagagaaggcaataaaagaatctaagtaatacttatatttaaaagatagcaaaaagagaataatgtatttcacaaatcatttttttaattcaaacatgggcaagcaggataagtcggtggtttgtttttaagtttgtctttcagaaataggcaaccacttctcattcagtctataaatgtgtgaaaattacagcacaaactgatagtggtttaaacggattatatgagtacctctgaagcaaatctaggcacatcactagtgttagcttttcttcctgttcatttaaagaaattaggtagaaaaccatacttttagtccattcttgcacaggaaagctatatttcttttactttagcaaacattctacctttgaaattctcaagattgttcttcttgttcttttctgctactgtatagcatctacttttctgtctctagttctgtgataatgggagggaatttcaggatataccattaaaaattataacattttattgatatcaacataattaagcttttagcatcctctattttcttctacaatttttactggtacatatgtatacatacatgtatgtatataacaaaaatgattaaagaaaaaaaggctatcaatttgtgtgaaaggtgggtgcctgggaggggaagggggggcaaagggaaggggagagatgacgtaattttattgcaattaaaagcacataacaatttttaaaattatttttacattaattactttaatgtacatctctctgtgtatgtgtgtctctgtgtgtgcatacatgtacatgtttgtctctgtgtgtgtgtgcacacacatgcatgtgtttgtatatgtatatgtcacagtgtctgagtgcagaagtcaattctcttcttctactctgtggttcctgagaattgaactcagtcaggctttacctgcctagctactccactgggcagcatcctctatcttcagtctttggtcagatagtacttttgctttgaaaatacacatagcatactctagacatttgacaggggtatgctctaaatgccagctgaaaacccaaaatttagctattttgtactttgggaaatatacaaggactaggttcttttttctttttacttttctttctgagtggaacttgtagtcagagttttaatcctagttctgctagtaacagaccattcaataatgtgagataatctagctcttaaaatttgaaaattgtgaaattcttaatatacctgcttgccttctttattatcgaatgaggttaaagcagttattatattctcactttatctctgatatattatctaattctacaagtagcaaagaggttataattaactatatatgatatatatttgggatgatttggattttttcttctcacattttacagacttgtccatgttattagatactgtggacaaaacgtatcactatattatgttactttcatctgacagtcgtttgaacgttcgaaacacaactgtgtctgtgcttaaaagttcacaaatgactttacattcttgtttaattgcagggagaacgggggtttccaggtttagaaggtcatccaggtttaccaggatttccaggtccagaaggccctccaggacctcggggacaaaaggtatttgtttcagtagccaatcaacaatagcagaggaattaaaccaccataaatttgagacaagctatcaaatcgactaaaagtccactgaatcgtaatgagaaaatagtgcttaaatcaaaaaacagagttgaaggaactcttattttctgtattcatttatcccttctttcccatttttcctccttcaagcagtgattaattacctatagtcctttgtctaggagcagaaccccataaaattgtctcatttttatattaacatgtgcattgatactgttgttgttccagacttcttggtaatcttgctgttagaagatttctacctcttcttctgtgatggtttcctgagtcatagatgcagagatgttgatgcaaggctggattccccccaaaacactgatctcttttttttgtccagttgtgtgtggttttgctgttgttgttgttttatgatgttcttcatttgccataatgagagatttctttgatgaatggtggtaactagacttattcagaaaaagtgtctcttcaccttagtgtttctaatgcttcaatttggatattattgtcatagtcaggtatttttcaggatgtcgtttgttatatatggtttttggaattctttctactttaaacttgtcctggggagatgcaaataaacatcttctcacccaccccctatgaacaccaatggcagacaattttatgatttatccaaagtccaaattgtgttgaccaaagaatttactggacttgccaactgaacatgaataagggatttcctacagaagtgtaggtgactgcaaaacagctgtatcactacaaggttccaccatatcatggataatgatctcatggaggctgctatgaagtctcactttgaatcagcttcctaactctatgtactctagcatcaccctaaatcagatattgaatgggggagggtcaattgcttgaatctcagataagtgtctctagaataatttttcctctacctactaggaagtgttaaagttcaattatcattaccataggtctgatgcatatatatttttctgtgaataagagtagcatctttatgtgtacgataagatagggaatgggaaaagataatagtgaattttgagaccaagaagagtttctttcagtttttaatggctcttttggctccgagcccttttcagtctgtggtagattgactggtaaagtggtgtatgaaaggtccaactctattcacttgcccaaaaagcaaaaaaaaaaaaaaaacttgacttaataacatttccctctagctttattatttcatataatgatggtgtaccatatcattagaggattaagaaaatcaaatggatatcaccaggtagtctttctaagaaaggaggaaaattaaatgcttggagatgttttaatataaagctagctataccagagggtagatgttgtgagaatgagggtacaactgtgaggaggaagtttttttttttttcagattcagcaggaaatgagtcttgtggttaaatgcactgaatagaacttcatatgaacactaaggaaacactaacactctaaatgactgactacatagaattttgaaagatgggccattcaaatgaatttcctaggtgctataacacagcaagtgtaagagtggcagtataatccttgccacccaggaatggcaaagaagtagtgcagacttctaaatcatgaactgagcataatacagcaaaacaactaaattcttccacttcgcagcacactggaacttaagcaacaacattctgaaaataaagtgggaacacaaattgattaattttcagctatgttatggaaatgagtgctttggaatagaatgtaatttgaaccatagaaaaagctgtttctcaaatgtgagtttatctgggaacagggccagagtttcttgcataacatggatattaagagtaaatatttgtggtttattaaaagaagttacattacaattattttgaaataatttagcattaactgagacttcttaataatagtataatagtttatgaagatgtgttcattcgcacattaagtttagagagtattactacaattccttttcattatttatagagtggaagtgggaacagctttctaaacattttacattctacagcttaaagtgtacttttgtgtgattggagatttactttttaaagttatatagatgattattcttcattggtatattcctttttatgaacatgtagatttgtaaaataaactgtccaattagcatagttgcttaaagtgtggtactgagatgtgtgtgtttatttatataaatgcacatttgtaatattgcaaaggagttctttgttaaattaaatgttccttttcagtagataatatattcattttattcacaattagtaaatattatgaatacaatgaaaaactcttttctacctgtgttcattggtccctgaatacatacccacattttcatcctctttgtttttaaaataggatgtattatgtttattttgtgtttttcttatatcagtgttctcaggatatgatattcttactacattcaatttcattgtatatataagctataaattagtatcaagctccctactcatgattatgtagttttcaatagtttgctgctataaaacataactgctaagatgaaaatctttgattaattcttattgcatcaataagcatgaattggaaagataaattgtgggaaatgggtgcccatgtctgcacatgtttttttacacatattaccagatcactatttcccaaacatttatgatttaccctttgatttagcaacaaagaagattcattttctcgcagattcatctctattcctaaaaaccttttctagttgtcattatggtagaagagtgacctttcaatatactttcaatttgcatttctctttttgtgattacgaatatgcttctcacagatcaaagtttcctttgtcttcctgtgatctctattttcatatcatttgccccttttctcatgacttggtgctttcatattttgtagagctatttgttaggaagattatttccatgcacacactgtacgttgtattattttaccctttgtcttttgcttttgtaggcatgtgcagggaaatttatgcatttatgaatctctgtctttaagtcacatggattttcatgagaacaaatcttatgcactttgagggtatatattaattctcaaaagttttctttcagtatatcaatttattttttatcctgtgtgaaacccatcctagtatacggtttgtgatttaagatacaccttaaacacaatcccacaacacccagaggaagctctattctcagatgctctaacatgccaggattgtagaatcaaaggtgaggaggacacagcatctgttccaacaacaccagaagcaactgggactagtgggatccagggacacaggaacctcgcctgaccagtgactcaggttccttctgctctacaccagtttaccttgggcacaaactccagagccagtcccacaccacccttaggaagctccactccaggctctctaacatgccgaggatcacagaatcacaggataacaggatcccaggagtttggccataccaggatctcagggtcccagaggcagcttgattcccaggaactctgacacacccaggatctcaagatcacaagatcctggaatcacaagatcacagagacagctggactctgagcagttctgacacaaccaggatcacaggaaggacaggctccagtcagatataattagtccaggtagcactagagatggcagaaagcaagcacaagaatataagcaacagaaaccaaggttacttggcatcatcagaacccaattctcccaccatagcaagtcctggttccactattacaccagaaaagcaatactcagatcaaaaatcacttctcatgatggtgatagagaacattaagaaggatgtaaataaattccttaaacagatacaggagaacacaagtaaacaggtagaagactttaaagaggaaacacaaaaatcaagaattacaggaaaacacaatcaaacaggtgaaggaaattaacaaattcatccaagatctaaaaatggacatagaaacaatagaaaaaaatcacaaagggagataaccctggagttaggaaacctaggaaagagatcaggagtgatagatgcaagcatcaccaacaaaataaaagagatagaagagagaatctcagaggcagaagataccatggaaaacattgacacaacagtcaaagaaaatgcaaaatggaaaaagctcctagccaaaaacatccaggaaatccaggacttaataaaaagaccaaacctaaggataataggtatagaaaagagtgaagattcgcaacttaaagggccagtaaatatattcaataaaattatagaagaaaacttccctaacctaaaggcagagatgcccnnnnnnnnnnnnnnnnnnnnnnnnnnnnnnnngaaaaaaaaagaaattgctcctgtaaaataataatcaaaacacaaaatgtactaaacaaagaaagaatattaaaaacagtaagagaaaaagatcaagtaagatataaaggcagacctatcacaattacaccagacctcacccttagactatgaaagccaaaagatcctgagtagatctcatacagacactaagagaacacaaatgccagcccagaatattatacctagaaaactctcaattaccatagatggagaaaccaagatattccatgacaaaaaataatttacccaatatctttccacaaatccagccctacaaaggataatagatggaaaacacaaacaaaaggagagaaaacgaagaaaataatctttcgacaaacccaaaagatgatagccacacaaacataattacacctctaacaaacaaaaataacaggaagtaacaatcatttttccttaatacctcttaacgtcaatggactcaattccccaataaaaagacatagactaacagactggatacataaacaggacttagcattttgctgcatgcaagaaaaagcctcgaagatatgggcacaggggaaaaattcctgaatagaagagcaatggcttgttctgtaagatcgagaatcgataaatgggacctcataaaattacaaagcttctataaggcaaaagacactgtcaataagacaaaaaggccaccaacagattgggaaatgatctttacctatcctaaatcagataggggactaatatccaatatatataaagaacccaagaaggtggactccagaaaatcaaataaccctgttaaaaatggagctcagagctaaacaaagaattttcacctgaggaataccaaatggctgagaagcacctgaaaaaatgttcagcatccttaatcattagggaaatgcaaatcaaaacaaccctgagattccatctcaaaccagtcagaatggctaagataaaaaattcaggtgacagcagatgctggcaagtatgtagagaaagaggaacactcctccattgttggtgggactgcaagcttgtacaaccactctggaaatcagtctggtggttcctcagaaaattggacatagtacaaccagaggattccacaatacctctacttggcatatatccagaagatgttccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcttaggcaaatggatggacctggagggcatcatcctgagtgaggtaagccaatcacaaaaaaaactcacacaatatgtactcactgataaatggatattagccaagaaacttagaatacccaagatataagatacaatttgctaaacacatgaaactcaagaagaacaaagaccaaagtgtggacactttgccccttcttagaattgggaacaaaacacccatgggaggagttacagaggcaaagtttggagctgagccgaaaggatggaccatctagagactgccataatcggggatccatcccataatcagcctccaaacgctgacaccattgcatacactagcaagattttgctgaaaggaccctgatatagctgtctcttgtgagactatgccggggcctggcaaacacagaagtggatgctcacagtcagctattggatggaacacagggcccccaatggaggagctagagaaagtatccaaggagctaaagagatctgcaaccctgtaggtggaacaacattatgaactaaccagtaccccggagctcttgactctagctgcatatgtatcaaaagatggcctagtcggccatcagaatatcagtggaaagagaggctcattgatcctgcaaactttttatgcctcagtacaggggaacgccagttccaagaagtgggagtggttgggtgggagggtatgggggactttttgggatagcactggaaatgtaaatgaagaaaatacgtaattaaaaaattgattatgacctgggtgggtgattattcccctgagggggaagaaacgcacttcagtgataaggacagacactatctagagtaaaaggttggaaaacaatttttcaagcaaattgtcccaagcatcaagctggagtacccattctaatatcgaataaaatcaactttcatctaaaagttatcaaaaaggataaggaaggacatataatattggtcaaaggagaaatcttccaagatgaactctcaattctgaacatctatgctccaaatacaaggcacccacattcatgaaagaaactttactaaagctcaaagcacatgtcataccccacacaataatagtgggagacttcaacaccccactctcagcaatggacagatcatggaaacagaaactaaagagtgacacagtgaaactaacagaagttatgaaacaaatggatctaacagatatttatagaacatttcatcctgaagcaaaagaatataccttcttctcagcacctcatggtgccttctccaaaactgaccatataattggtcacaaaacaggcttcaacatatagaagaagattgaaataatcacatgcaccctatcagattaccatggactaaaggtggtcttaaattccaacaaaacaatggaaaacacacatacacatgaaagatgaacaatgttctactcaatgataacttgttcaaggaagaaataaagaaattaaagaatttttagaatttaatgaaaacgaagacacatcagacaaaaacttataggacacaatgaaagcagtggtaagaggaaaactcataggtctaagtgcctccaaaaagaaactggagagagctagcagcttgacagcacacctgaaagctctagaacagaagaagaagaagaagaagaagaagaagaagaagaagaagaggaggaggaggaggaggaagaggaggaggaggaggaggaggaggatgannnnnnnnnnnnnnnnnnnnaggaggaggaggaagaaagtacacacaaaagagtagaaggcaggaaataatcaaactcagggctgaaatcaaccaagtagaaacaaatagtactatacaaagaatcaacaaaacaaagaactggttctttgagaaaatcaataagacagacaaacacttagccagactaaacagagggcacaaaaacagtatccaaattaataaaatcagaaatgaaaagggagacataagaacagaaaccttggaaattcaaaaaatcatcagatcatactacaaaagtttatactcaacaaaattgaaaaatctggctgaaatggacaattttctagacatatcctaggtgccaaatttaaaataggatcagataaatgatctaaactgtcccataacccataaagtaatagaagcagtcattaattgcctccaacctaaaaaaaacccaggaccagatgggtttagtggagaattctatcagaccattaaagaagaactaataccagtactcttcaaacaattccacaaaatagaaacagaaggaacactacccaatttgttttatgaagccacaatcacgcatttacctacactacacaaagaccaaaccaagaaagagaacttcagaccaatctcccttatgagcatagatgcaaaaatactcttgccaagcgaatccaagaacacatcaaaatgatcattcaccatgatcaattaggcttcatcccagagatgcagggatggttcaatatatggaaacccatcaatataatccatcacataaacaaactcataggaaaaaaaccacattatcatttcattagatgctgaaaaagcatttgacaaaactcaccatcccttcattaaaagtcttggaaagatcaggaattcagggcccctacctaaacatattaaaatcaatatacagcaaaccagtaccctacatcaaactaaatagagagaaacttgaagaaatcccattaaaatcagggactagacaagactgcccactctctccttatctattcaatacagtacttgaagttctagctagagcaattagacaacaaaaggaagtcaaggggataaaaattggaaaggaagaagtcaaaatatcactctttgcagatgatgtaatagtatatataagtgaccctaaaaattccaccagagaacccctaaacctgataaacagcttcagtgcagtagctggatataaaattaactcaaacaaatcaatggcctttctctacacaaaggataaacggactgagaaagaaattagggaaacaatacccttcacaatagtcacaaatattatagaataccttggtgtgactctaactaaggaagtgaaagatcagtatgataagaacttcaagtctctgaagaaagaaatcaaaagatctcagaagatggaaagatctcccatgatcatggattggcaggcaaatagagcaaaatggccatcttgctgaaagcaatctacagattcaatgcaatccccatcaaaattccatatcaattcttcatagagttagaaagagcaatttgcaaattcattcagaacaaacaaacaaacaaacaaacgaactcaggatagcaaaacctattctcaacaataaaagaacttctgggggaatcaccatgcctgacctcaagctgtactacagagcaattgtgataaaaactgcatagtattggttcagaaacaggcaggaagatcaatggaatagaattgaagacccagaaatgaacccacacacatatggtcacttgatccttgacaaaggagctaaaaccatccagtggaaaaaagacagcattttcaacaaatggtgctgttcaactggcggttatcatgtagacaaatgcgaattgatccattcttatctactcgtacaaagctcaagtctaagtggatcaaggaactccacataaaaccagagacactgaaacttatagaagagaaagtggtgaagagcctcaaacacatgggcacaggggaaaaattcctgaacagtacaccaatggcttatgctctaagatcaagaaacgacaaatgggacctcataaaattgcaaagcctctgtaaggcaaatgacactgtcaataggactaaatatggcaaccaacatattgagaaaagatctttaccaatcctacatctgatagagggctaatatccaatatatacaaagaattcaagaagttagactcccaagaatcaaataaccctattaaaatgcagtaaagagctaaacaaataattctcaatggagaaataatgaatggagagaaacacctaaagacatgtttagcaccctttgtcattaaggaaatccacatcaaaacaaccctgagattccacctcacaccagtcagaatggctaagatcaaaatctcaggtgacagcagatgctggcaaggatgaagagaaaaaggaatacaccattgctggtgggattgcaagctggtacaaccacttggtggttcctcagaaaattggacatagcagtacctgatgacccaggtataccattcctgggcatatccaacatgtaataaggacacatgctccactatgttcatagcagccttatttataaatagccagaagctggaaagaacccagatgtccttcaacagaggaatgtggtacgtttacacaatggagtactactcagctattaaaaaggatgaattcatgaaattcttaaagaaatgtatggaactagaaaatatcatcctgaatgaggtaactcagtcacaaaagaaaacacatggtatatactcactgataagtggatattagcccaaaatctctaaatactcaagatacaattcacagaccacattaggctcaaaaattaggaatactgaagtgtgggtgcttcagtccttcttagaaggagaacaaaatactcacaggagaaaaaatggagaaaaagtgtagagcacagactgaaggaaaagccatccagagactgtcctacctggggattcatcccatatacagttaccaaatccagacactattgtggatgccaaatagtgcatgctgacaggaacctgacagctgtttcctgagaggccctggcagaggtggatgctctcagccaatcattggactgagcacggagtcctcaatagaggagttggagaaaggactgagggtgtttcaggggtttgaaaccccataggaagaacaacaatatgaaccaaccagaccccccccccagagttcatcaatgaagccaaagccatcaaccaaggagtacacatggctccaactgcatatgtaacagaggacagccttgtcaggcatcaatgggaggagaggtccttggtcctatgaaggcttgatagatgccccagtgtagaggaatcgagagcagggtggtgggagtgggtgggtaggtgggtgaaggaacaccctcatagaagcagggggaaggatgggatagggaatttccgggagggggtaaaaattgggaacgtggataacatttgaaatgtaaataaagaaaatatccaataaaaatgccttgattttttctccactcatttacaatgaaatattcattatagagtagccaccctttatttgtagtttcatttcccatgatttcaatcatatgcatccaactactgtatggaaataagctgaaattcttaaaattaataattaatgttttccaaaactcattataatatgttgttatatttgttttatattaccctttgatatttttaaagtcttccagtgtttataaattttgttacatttatgtgtacatatgaaaatagaaatttgaatatagaaatttgctttctgtctacattttcatgtggtgactatgtgggatcttagaagctatccttggctaaagagtggcttctgttttctaagttcatttgagctttctttctgaaaatcttctagtattcactttatccaaatctaagtcccaaactattttaataactgaagccttgcttcacttttatgtctgactgatgtagggcccactatgttcttttttctttttacaagttttcccacagatattgctggggtgtttttgcctatataaactttggagctactgtctagtcttaaaaaaacccagtaacttctattttcattatataaaatttctatctaattttgtaatttactgtttaaattggattcctttttttaaggacatggaatttcttttttatacatatttaactacttctttgtgaagttcacaactgtttttaatcctttcctcttgtaaatcttgtgcatttcttgttaaatttactgcaaaatattttgttttgtcattattggttgagtattttcttctattaagtcttgtaaatggttgttacaataataaagctatcttttagtattcactttaatccaaatctaagtcccatttattttaataatgtgaagcaaggctatgaagacaaggctggcctcaaactaggggcatttttttcttctttaaccttttgacttttggcaatacaggtcctccataacttctaactttgtaattttctttcctgaagttcttctttaaccatgttgctggtctaactggtgcaatactcacacttttgtcttatttctgccttcagtgagaaggcataaaatatttattgaacaagagatcttctagttattttaactgggaatcagaatccattgaatcttctcacaaacaagtctgcttcagaaagagtatgtcattaaactttttaaaaggagacaattttaaagggacttacagactttgcattaacagtattcatgtccttgtcaaaatctgtggatatactactttacaccaaactgtattaggtcttttttattcaaaactttaaagaaaatacttaacaaaaaattcacggagataaaattgaaacttttcagcaatgcaggggtgactaaaagtgagtaggtagaatttgcaaggaacagagaacagaagctggaagggagagtttatgacttttaagttctataaaaagtgctttctgaaataaatggaaagataaaagcaaaagttcacaaacaacacgtacacctgcagtttgatgtgttatagaaactgtcaagattttgattttctccgtctctctctctttttcttccctcatgtacaaatttatcttcattttcttgtgtgtgtcttgtatatctttctgcatgcaacatttcttcttcatgtcaacagtctccccagtaaaatactggccgttcttggtattgttcatttaatttatcagtggtttgaatcttaatcataattcttgtttgggtgtatgaaattagcactaattttcagaaaagtttaccaaaaaattcaggctagctaatgaaaaattagttattagatgactgctttgaaggaaaaaaaggaactaaataatattgtgtttttcagggtgatgatggaattccagggccaccaggaccaaaaggaatcagagtaagcaatattcagtgtacgggaaatgctttgttgttgtcaacagataagaccaagtaaaatggtatgagacaacaagaaactaattatcattgctcacaaacatatatacacatgtatgtttatattacatcatatagatacaacatgctaagttcatttactcttgcttctatgcattcatgatttcaaggatgaccacttgttattggataatcaaatggggggggggtcatccctgggatgaccttaagaaagactccctctcaagcgtcattatacatttgtagttttgtgtcaaaaggtgcagctctctggaattttttcccattcatattaccacatttgttcatagtcataactcaagagtattgtccatctatgtggggaactcaaggcagcaggggttcgtagcaactggtcccatcactttctcaatggaaagccaggatcgacagacatacttgtgctcagctcacttactttatctagttcattatccctttctcagggaatgatcctgaccacaatgaaaatagttcttctcacatcaattaatataactaagataatccctataggcatatccagaaggctatttccctagtaattctagattctgtcaagttaacaactaaaatgaaccattagaacagctctttgtcagcctgacacatcaacacaacacttttatgccataactttccaagctttgtcctcataggttcatgacaattatatgatctaaaatgcattcagtccaacttttaaagtccccttcatactaagcctcttaactgcgagataccataaaattaaaaaaaaaaaagcaatggatgtacttcaacataatagtggcacagaataaatatccctctccaaaacagaagtgggacatagcaaaaaataatcacttcaacataaattaaaatccaaacagataaagatcaaatcctgcaactctaaggctagcatctagaggttgtaatgtggtcaactggtatccaaaacaccttgagcagtcccacaaacccttagttataccacctacaacacatacattattccctaggcttgcttttttccatgcccacagctttccttggcagctgtcccttattcctgacatctccactatcttggggtctcaactgcaacttagtatgaacctttacaagttcatactttggcctcttaggacgtttttgcagagatttcaaccataccataaatcctctgaccttagatttaaaaacaaacaaacaaacaaacaaaaccccaataaacaaaaaataaaactttacagaatgactcagtgacctgcttaaacttatctttcatgccccttaaacttgtacaatgtgaactacattgccaagttctgcttctagctcttgatggaggctctgataacttcaggataactttttgtttgtcccagtgcaatgtagatttctcttcaatgatcctgacatctttatcaaatatatatattctcagtaccaggctaaattctctcccttattgaaatgtcctctgccaaatacattaatccattactttaaatttaccttccatcaacatctcaggaagtgatcagaatgaagacaaattgctggccaaaatatcatatgaatgctctctagcacaattgttggcggagtcctagttcctcctgaaatctcagtgacctgcccccactggacatattcctcccaatgttcttattttccaagttcccagaagaagaaccattaagctctgcttattgtattctgagacttttctttctttttaaaagtttatttatatatttttttaaaatgtaggagtgctctgtctgtatatatacctgcatgccagaagaggacatctaatccctttatagatggttgtgagccaccatgtggttgctggggattcaactcaggacctctggaagagcagccagtgctcttaactactgagccatctcaccagccccaaggacttttctaacccaatgtttcatttcttccacattcctcctgaaaaccatttccaaaggcctaagacttgcacagtcaattttatcagaacaatgtcccaattcttggtaccaatttctgtattagttcttttgctattgctcagataaaattttctgttaaaggcaatttaagggagaagagatttatcctggcctacagttcaggggttaaagttgttcataataatgattaaagccaaggcagcaagagttttaagctttaagttttaaggtcacactactttcacaatcagatgcagagcagtatgaatacactcatactagtgcacagcttactttcatccattttattcagttcaagatccccaagattaaggaatggacctgtccacaattaagataattcttcccacaacaattgataattccccacaggcatgcccagagagccatctctcaggttgattctcgagtctgacaagttaactgctaataccaaccagtatctggttagtatatggctggttttagaattagaggatactgggttaccaatagtggtagttttcaaagataagttctatcttctgtgaaccccagtttcttcacatgccagaatatctcttttagctccaaacttctgtttatagagaaatgtctcttactttgactattagatgcatggatggctacataacatgcttatatgtggattcttatcacaactttcacatttttaaattatttgatatttaaatatttagattaaaaacttgcacaaactttaaaaacattatattggctatataatttttagcagcttgtagtatcccaacttggtggatcagtactgggtatggaattttgactacttctcaaaaaatgtaaacaaccaatccaaaatgaaaatccatctcagttgccttatgtggtgtttataactggagtggatatagtattgaacaaaaaagacaagaaagtcaaaatctttagttaagatttattttatgtatatgaatgcactgtcactgtctttagactcaccagaagagggcatcagatcccatcacagatggctctgagccatgatgtggttgctgggagttgaactgagagacctctggaagagcagagggtgctcttaacccttgagccaactctctagtccaaaatctttagtttaatctgacaggtataactatgatttttgtagtaaattcatatcatatgtaccattaaagatcttcataattacacaatatctcaaatagccataaatacctacctgtgataagcacagtggaaactaaaaagaacttgtcattctattaacagcttcttccggatatcttggagtgttcttatagaccctctttctgaagtacaactttagagatgcttgatacagtatggacttttaggtgtcagattacagactattgttgatatacaaagtttaaaagtagaaaataaaataagtttagacaaagagaggacacaacatccttgtgcttatttctaccctcaaaacaatagaacactttgccattttacttagtctccaaacaaccaccatttttgcaaatgttttaaagtcaatccctcacatctttcactttgcaaatgaaacttcagtatgtctccatgactattaaccactatactcttgtcttatattaacaatttaaagattacttttcatttactctacacttcctcgggccaccatttttagctggtattttaataaattaatgaacatctatcacttcttgaagtagtgatcaaggaacgttttggctttttttttttaaataaccaattcataaaatgtaatgtttcaatcaattgaagctattacgtttttgaggtaagttctcactttgtagacttggctagactcacgatcactggcagtgctgatattaaaggtatgcagcaccatacacattagttttttgaaagccattttgtaccacccttaatctgttaggagtcttttcaagtttgcttcttgcccattgtcacttttacagaagtcattgatcactgagacgtccttgcttgctgccatacaagtctttcagaagcatcctctgcttttttttttttttgttttccctccaagcattgatccaatagcgctgcaataacaaacctaaagcagaacactgtgttttctaatttgtagtgtcctttgggatgggtgcacagaagtgaattgttatgttacaggatatgttgtattgttttggtagatattccaaattcccatgttctcaccacaggcaagagaacgagtttccctatgtcctcaccaacagaaatagttgtcgagttctattttactgatcccaacaaggagatttaattgaaagatgcttggggttagttatattaatgtcctcagagagagatccatttgttgccctctcatctcctagtaaatttattattcacaaacctgaaagaattttatctgtaaagacaggcatttctatctatctatctatctatctatctatctatctatctatctatctatttatttatttattttagttattttctttatattcatttcaaatgctatcccgaaagttccctataccctccctctgccctgctcccctacccacccactcccacttcttggccctggcattcccctgtactggggcatataaagtttgcaagaccaaggggcctctcttcccagtgatggccgactaggccatcttctgctacatatgcagctagagacatgagctctgggggtactggttagttcatattgttgttccaacacccaacatacaatttgcaaaacacaagaaaatcaagaagagggaagaccaatgggtggatacttcattcctccttagattgggaacaaattacccatgtaaggagttacagagacaaagtttggagctaagacaaaaggatggactatccagagactaccccacccgggggatccatcccatagtcagtcaccaaacccagacactattgcatatgccagaaagattttgctgaagggaccctggtatagctgtctcatatgaggctataccagtgcctggcaaatacagaagtggatgctcacagtcatctataagatggaacacagggcccccaatggtgaagctagagaaagcacccaaggagctgaaggggtctgcaaccctaaagacagacatttcattcactgctttgctttccgctgctaactgtaatgaagaaaatgtgcttacaaacaggagactctagttttctgtaaaaggaattttaaagacaactctgtgaaagagtgttactaattattaaaccaacagtgattggtaacaatgaggcacattttgtaatagctttgtcatttaatcaagcgatttctttattattatagggtcctcctggacttcctggatttccagggacaccaggtcttcctgtaagtatggtttttattcttttaaaatccccctaagaagtaatataagaaatattataagtgtgttatatgccttttcaaaggggatgccaggccatgatggggctccaggacctcaaggtatccctggatgcaatggaaccaaggtgaggttggttttttttttttttcaacttaattgtaaacagattgttgattaaaatctaaaaagagacagggtcattttgtgtctaagacaacattttcagtatattaaatttcagtaatttatttaaacctgtttaactagtgaggatactgaattgggttagggggtattttaaaagtctttgtgtaaagtattataaatattaaaaatggattaagacttgtgtgtttcacatactatagaagttgttatgggtaatacttggtaatatcttactaattttgatttttaaaatacgtgctatttaaaattttgaatacttcatgttttaagcttaaaaaaattgtatgttattgatgccgtggaggaagaaaccgatgtatgccaccgagcacacatggggttcagaggacagcttgtgggtatttagctctttctaccttgtggactatgggtatcaaattcagattgtctgcactttggcaacagacacctttatctactgaaccatctcagtgatttgattcatgctttattttttaacttccttaactgtcactgtgaaaaatacaattttttcatcaacaaaaatggtgcacttaacaatttaaaaaccccaaagctttagataatggtacttttcttgtttggagtcaacaatttaacattaagacatagcaatacataatgaggaaaatgttcttattataaaatgatattttatagcatttgatttttttatttcttgttttttcttttcttaagtaaatgcaccattactttatgtttatccttttagcattttatgttttgtgcataagattctacaaaactagatctatactatattttaaaattaatgtcatatcccagatttttacattagggtatacactttagttaacttcctgcaatacaaggaacatgttttctgagattttaaaaacatacataaattgaacatattacttttaaacccagtatttctcaggtctctgtaacccttgccaacaataatattttttttttcttaacacagagtcccactatgtagctctggctagcctcagactcacagaaattcaccgggcctctatctcccaagttctgggaactaaatgtgcaccatgtttgtcgcaacaattatatatatatattttgagacagggtttctctatatagctctggctgtcctggaactcactttgtagaccaggctggcctcgaactcagaaatccgcctgcctctgcctcctgagtgctgggattaaaggcatgcaccaccatgcccggcataatttttttaatgtttagattttttacatttttattagatatcttcttcatttacatttcaaatgctatccccaaagccccctatacccctccccccctgccctgctccccaacccacccactcctgcttcctggccctggcattcccctgtactggggcatatgatctttgtaataccaaaggcctattgatgggagtctaggccatcctctgctacatattcaactagagacacagctctggggagtactggttagtgaaacatttacacaatggagtactactcagctattaaaaacaatgaattcatgaaattcttaggcaaatggatgcatctggaggatatcatcctgagtgaggtaacccaatcacaaaagaacacacatggtatgcactcactgataagtgtatattagcccagaaacttagaatatccaagatacaatttgcaaaacacatgaaacttcgctccttcttagaatggggaacaaaatttccatggaaagagttacagagacaaagtttggagctgagacagaaggaaagaccatccagagactgccataccctgggatccatcccatatacaaccaccaaacccagacactattgcaaatgccagaaagattttgctgacaggaccctgatatagctatctcttgtgagtctatgccaatgcctgacaaatacagaagtggatgctcacagtcatctatcggatggaacacagggcccctaacaaaggagctagagaaagtacccaagaagctaaaggggtctgcaaccctataatgtgtagatcattaaggcaaatatctggaattgagaaatttatttatgttcttcattctagctgagacagtctttgatggttggaccaataggaattttgtttgtataacacatttcataagaaagtgaactatggtgatggagtaatatacaattgatgaataaagagataggctgttaaaggctttgaaataaaaaaaaagaaagtgaactattttgttcctattctggtggcatagctatgttttactttgttccttttgcttgtgtgtgtgtgtgtgtgtgtgtgtgtgtgtgtgtgtgtgtgtgtgtgtgtgtgtttggtatgtatgcatgcatgtgtgtttgctagcataccttttgcaacaagaaaactagtattcaaagttttaaataaagaaaccaaatgcacatgcagatatatttatggtgaaagagatatttttcacaaagtggtcttttcatatatctaacaattaatttatgttttagggcatcatttatggaataagttttatataaattaagtaattttatcgtacatggtgactggttagactttttttacccttctcactaggtatgtaaaatttgattcctaatgttgcatccacaatgtatggattcttttctaatgtcattggacctagtttattttttattaggtattttcttcatttatatttccagtgctatcccaaaagtcccccataccctccccctcgctcccctacacacccactcccacttcttggccctggcattcccctgcactgaggcatataaagtttgcatgaacaatgagcctctctttccactgatggctgagtaggccatcttttgatacatatgcagctagagtcaagagctccggggtactggttagttcataatgttgttccacctatagggttgcagatccctttagctccttgggtattttctctagctcttccattgggagccctgtgatctatccaatagctgactgtgagcatccacttctgtgtttgctaggccccggcataatctcacaagagacagctacatctgggtcctttcgataaaatcttgctagtgtatgcaatggtgtcagcgtttggaagctgattatgggatggatctccggatatggcagtctgtagattcattggacctactttgtccatctataaaaggtgattcagagaaggccattgcatagtgattcaaaagcacagtggggtagtaattttgcccctttaagcctctgacatgtttgtttctagaattgctatagcatacataggcatttggaaagaatttgaattaattttcttctatctcaattttaacttgttttcaaaccaaatgtctatgttcctactttgcaatagtgaatgaaaaagattgggtacctaagaaatctaatggcctgcaatttctaaaaccgttgttactgtattcttggtgctatcactagctttattccttgccatgttttacattttgaaaaaaaattgaaatagtttacaataagaggaaagtgaaatggtaagtttttaataagaatttgtacagtacctgatcaggaacttgcagcaaatcattaacaattaaatgtgatggttattggaaatctgtggtgtgatgggctcaaagtagatttttcaaaagaatatgacagtgagactgttttctccttagatttggttggggtagatgagtacgaataagagtgttcggcttggtaggttgaattgccacagacagttgattctgaagttattggaaaggggatgctaatgacattttggtgatctggtatgcatttgtcgtacaaattttcactgtttcttttttctctacactcttcctttttaactcccagggagaacgtggatttccaggcagtccgggctttcctggtttacaaggtcctccagtaagttctacacttcaggattaaaatgaattcaagaagtaacagaacagaaaaagtgtgaatacagagtttactcaaatggaacagcatcacatatttaaagtgtaaactagagaatttcaaagattaactggcaaaaagacttcctgcagattaaagccaaggattctgtgatggctagtataaattttacctataaaatcctctaatataaaatattctaaagtgaccctataaaagtttattcattttgttctcctttatgttatattcatatgtacatcatattttttgtttataacagtcaaatttgcacaaaatttccttctttcttttaataatagggacctcctgggatcccaggtatgaaggtaagcatcacatgctaagaagataagcagtgtgaataaaatatgtagaatgtctacaactgcagtagaatattactgtaagttcagtctccaaatggatacatatggagagtatattgtttaagcagtatactatgcaatcttatataatgtaattcttgaaaaagaagtgtgcattgtgctcaaatctctcttttctaacacattcaggctttatctgattgtattttgctagggctgactgctgaatatctctagatgattatctcttctttatccttggtttctgtaacactctagtctcctagcatttcttctgcatctgatagaccttcactctttagtacaagttcattctgttctgtccagcagccattaagacacaaacctgactcttcctgctcttctatgcctggtaatattaataatgttcaaggcatttattgattaggtagttactggccatctacattgaaatcttcaaattagattttttttctgagttcaagatttatgagttcaacaccctccttaaaaatctctgctcaaatatctccaagacgtatgtatgtgtatatatagtgtattcactatatatatatatacatatatatacacatatatatattcatataatacatgaacaaactatatatatatgaatataacatatatatagtttgtgttattatacactacataacttttaaattatatatacttattaattcttggaaacatgtacattcaccatattttgaattatgcctagccccaactcttccacgtctatctccactctcccacattccaagtcctctcttctctcatagcccattgagttcagtgtgtgctgtccatattctcatgggtttaagtccaaccactgaagcatgatcatcctgtcaagagccatacccttaaaggaaatggactctccttcacctagatgccatctgttgtcactaacttctctcatctagtggatggggtcttataaggcccacctccctcaatactgcaatgatgacctagttattcttgtgcaagcaactacaaccaccatgaattacattatgtccagaacacactatgttgccccagtccttcttaatgtcttgtacttataaattttctacacccctccctttccattaagtcccctaaatcttggaagaaggggtgtgatatgaatgtctccattatgactgagcataccacttaataaaatacccatgacagtcattctctatactttgatcagttatgcactctgcattaaccattgtcaagcacacaaagacatttctctcattggatctaaaggttaaactgataagatctaatgagtagagcaattggaatttagagggaaatttgatactatggtcctagatatacaccctggagccaatgagcttcctttcaatgtgttcttagtcagacttacactaacagtcaagaatttatcctgggaagtgtgccttaaaacaaatcacagggcagttggacacctctataacatcaatgccacttacccatgtgcatatcttgtcatgtgggtcattgttgtagcaacagccttattttaagacatttttcctttgatcactagtctcactggtctgaatttagctcatttgagaattttaattttctattattttttttatgacagactttcatgcatgctagataagcactctaccagtgagccagtgcagcttttagtcatttgtgggaaattatgcttattctttcggctgagagttacatactcttttcacattactctaatatgactgcctagttaactatttttattacttatttatcgctcactatgccattttgctttactttatagactgcaacagaacacactaccgtcttgtttacttgttatgttttatatttctccattatgtttttagcctcaggagaaaagaggctctacttctttattactaagtgtccagagcctaacacaatgctccacaaacactttatatctaatgcatatttctaattaatgaataactaaaagtgccacaaactcctaataaatctactgtacattggtataccatggatacttcttaattgacttttcaaaggtaaatttgttcatgaaattaccggtgtgctcagtctttcacttatttatgtactaaaatgaactctcagaatgtctttttaccttcttgctgtttctcatgtataataatgattttaacttacactgttggtttcttttagggggaaccaggcagtataatcatgtcaccactgccaggaccaaagggtaatcaaggatacccaggtcctcctggaatacaagtaagagtatggggaattttttctttattacatgattaaaacataggatcatatgagtcctgaccttctatactcactgttgctgttttagttatacaaattatcacctgaagttcttaaggtctcaatgcattccttctattttaaagtaaaagtttttacaaggcatatttgttttcttttatctatgtatccagtgtctgtgggtatttgtgtatgtggcaacagaagtttgcatcaaaaataatttctgacattcttcttctgctataggtagcagtagggttgaccataaatgttttttaacaaataaaattatcgatctctcttttaagatgttaaaattgccatttataacagtatcaattatgcatgatatctgagcagacactgaaggttgaaggaatgcaatttatgcatggtaaacatcaaatgtaatcttacaaaaagattgtgttagtttatagataatatacagagacagtaatgacttttgagtatttatagatgaggaagttcattatagtttatgaaaatcaatccctttatcaaaaatacaaatcaggaggttttactgtttgatcacaaagatacaattttggagatttttttcatttgttcattttttattctttacctgacattactagtcataatctcttaagttcattcaaatattctccttaatcatacatataatttttaatgaatatttaagataaagtataacagatcatatgcagaatatatgctgagataacacaaaatgaacacctaggaacactactaaacccaacagaaagttacaaataattttgaatcaatacaatgttacctggaagccacagccttcttgattgcctcaatatataactaggagcctgagcaaactgtttaaagttgctttattccctcaactgtatcagctttcctttacagtatgtgatagtcacgtaatctgctgcaatgcatctgttttccttggcttgttaaggttcattcgtattgttttgctatggttcattttttttcttttttcattatgtatttatcatgtttttgtctatcattgtagaacataatcttgctgaaagctgtaccccatctctcttattgagttaccttttaagctacttagcccttctatttgtacaatttttaagccctgatagtattgcagggttatagacttatgaaaataacttaacttgcatacatttatttctttatatgatgaggtaaagggttgagtttagggattttgtttttcatacttctttcctcattaaaattgataaaatatagtctttaaaatatattgtttactggtttcctttcttaataacatgagaaaatagaattaatgatttctctgtttttgaggattttttcctaggggggagggcgagagaggtgactaagcgatatctatcaccctgagaaccagtgagtttattagacttacttagaattgacaataagttactaagaggagtgcaagtgacctaaaagccacactgaaaagtctttacccaggatgtagcagggctttcctgaagccatgtagggagctctccctttctctaggcttcccagtccctgaccctagatcatccataacatcttgaggctttgtatgactaaggcctaaatataaaatcggctgggatggctctgtccatatcctccttttgttaaggaatgtaacatttaatctgtcccactgtgatcatgaagacagcacttgtttaacttagagcagaagccccacattctaacatacttttctttactccatttataacagggcccacctggtcccaagggtatatcagggccaagtggtcctccaggaccaccaggtttaatggtaagtttctgtaattgtatttttttctcctttgaattctgatccatggatataattactgactatattacttgaaagttaacttaatttcaatatccatgcctttaattttgttatttaacactggctctgatatggtaaagaatctaaacaagcaaagcccctatatattcatacaggtgaaaaaatacatacataaaaataaatacaagaaatgggagctggacatatagctaaggtagaatgcttgctgagcacacatgaggccctgttctgtccagtgcaggaaatataaagatgataaatactactgtaatacttagatttcattgtagtcaagattggagttagacctttgctgccatcctcttaaaaagacaacaaaattgtattcccatcaaagtaattttatatgcctttctgtgtcctatatgctatgtacttcagtgacaattttcatattttcattatgcttttatggataatgcacttttgtttgtgactattggttcttactcttcaataggggaaataatgtatgctacattccagacaagcctactgaaagtccttagaaagacttaaccactaccctcccccattagtttgatttaattgtaaacgtggtgcaatcagggaattctgggccatggaaccttttcataattctgttgttacagtattggtgttatctgggtctgttattaaaccctgaatttctttaacccttgtaaactaattaaccgattccctccacacttctgaatattccttcaattaacctgtatttaacagaggaaacaacgtcttagaaatgacactgaggtatgatatggaagtaaaaagagaatactgatattaaaagcactatacataggcaggcaagtgcctatttaatattttaaaactattgtccttatttgtaagaatttcatacatatacacaataaaatatgaccattttctctcctgttgctcacctctaactctccccacatgcctgtcaacatcccccccccccagcttcatgcttttaaaaaagttacccccaaagtctaattattgctgtccatttgaaaatgggagtgaggccatccatgggagcctgggaatcctaagagtcgccacatcctcagtagagggcgattgccccttcgctagcagctgtcaactgctgttagctcctcagtgagaagaggggactggaggtcatctatactatctatgctgagattttagctgacatgatcttgtgactttctaatgtaggtaaccccagtttttgtgacttcaagagtgcaatagtcatgtcatgtctagaaggcaactgtttacagcactacttctcatttccaagtctttctactttctcttctcccaagctttgggcaggagagttgatagatatgtccagtttagggctgaacacccagtctcttattctcagcactttgactagttatccatgtctcccattgactatgcccctgttacaaaaaggagtgtttctaaccaaacttcaaaacaacccaagtccatgggtataaaaataaataactaaannnnnnnnnnnnnnnnnnnnatgggcttttgaccagggttgcaatatgaggtttgacattcctctagaatgtcaatcagaaaatgattagttatccaataacagtcaggccactattgtaccagtaggcaaaacttatctggtaggtaggtattgcagtatgcaggacccagcactggttgacacactcatgtgttttctctcccagcattcttcattttaccagctggcactgagaaatctggccacaagggagaaagtttccttgtgtgtttgcgattgacttctctgtatcctgcagctaaagtgggagggttcaacaattgggtcttatcatatagttatggagggtaaccaagaaaagcctacttaatttttcatgtcctgagacatgattagaaattcaaattgagcatgtgctttaaaaaatatcaacttcattgtttcccataattctgataaaaccatgttcactgaagttaagttctttggtttggggacttgcgctatctcccctctcatttatcgatcctagttttctactcctgccaattctcatcctgtcactgacttttctacatttgtctaggttgttttaatcaattgaactgtgtgcctctgatgaaaacacaattatgaggggaaaaataggattggcttggtacctcactttagtacacagctgctttatctctgagctatatccccagaattaaaaagagtttgaaggtccttttgggttgtcacattaaaaaaaaaacaaatagttttaaagaaacatcatactaaaatgtttttttcctccttcctgcgtcttctaagggacctcctggcccaccaggcccaccgggaccaaaggtaatgttctttctgttcacatcatttgtttcctgtgggttaggttttctgattgttattgagactttaaatggaaacttctctccccaggggaatatgggcttaaatttccagggacccaaaggtgaaaaagtgagtaatcaaaagttggtcatccagccttcatgcctctcctttcacatgcacctggactgtcttgttcctccccctgtttcttatgatggacatagtttacctataatattgttacttgtagtagattatgaaatatcactatatctttgttgtgtaaatagggcgaacaaggtcttcagggcccacctggtccacctgggcagatcagcgaacagaaaagaccaattgacatagaatttcagaaaggagatcaggtgagccctcagggaggggaagtggataaagactgtgctatagatatgttaattagcttgattggggtaatcatttcacaatatgtaggtatattgagatatcaccttgctcattcttaatatgctcatttttgtcaactctagctcctttaatctattttttaaaaaaatatgaaaaatttaaaactgaaagaccttgctcttataaaaggcactatatatagacatgtattattaattgagggtattctttcaataacaaggacttcggataattagatttttttaaaaaataaactagtcacgatgtcgttctgctgttaatactagatgaacctaaagttcacattcttgaacatgttttgtgattatctccaggatagggagaaaacatattctagtactaatgtgctttcatttttctccatacctgcatagggagttcctggtgatagagggcctcctggacctccaggaatacctggtcctcccgtaagtattccaagactctttagcatcatttaatgtgaactgatatctatagacaatacctcatgaaccaatgtgaatattgattttttgcagggtcctcctggtggtgtgaaaggtgaaaagggtgagccaggagaggcaggcaaaagagtaagtgttatgaccatcaatggtgtttataagaagcctaaatatgttcatgtgcgagatctctttctagttcctaatggcattgcctgaaaatgtcactacaggtataacctataataatacctgtcatgcaaaaagtctattcagccaaacatttgtggtgcactttgatctcagaactcaggaggcagaggcaggatgatatctatgatttcagggctggcttgatttatagaacagccagggttccatggagaaaccctgtctcaaaaagccaaaaaaaaaaaaataattaattacttaattaattttaaaagagcactttaaaaatctatttacatagttcaaggcagaagtaatggttgctatagtatttcctctcctattaccaaactaacaaagttttgttcacactccatcattgctttgcatcctacagggtaaaccaggcaaagatggagagactggccaaccaggaatcccagtgagtagcaatggtcctttcctttaacaaaaaacattggtagtatttgcactatttgtgggtggtaatagaaaagcagagggcacacagtatggagtttggaaatagtttagatgaatggaaattatcatcacctttctgaatatgaatttggaatgtctctagttttaaggcagatataatgaggtgtgctttaattattgtttagaatcttttctagttgctgtaaagacactaacaaaactatcttaaacatgaaagtgtttatttggctacagaatgatacagtccaccatggtagagaagacgtgcagtagtcaggaaaagcatgttggaagaaacagagactggattgtcacatcataatttcccctcttcctcttcctccttctccttgtcctcctcctcttcttctttaccatttcatatatgcacctctttcatactgaccactcttatctcttacctccctacctccacacccatctctctcatgttcatgtatattcatttagttttatagctcagaaagattaatccaaatccttggtaacactgagtttggagctatgtgttggagactgatggactcaagagagaaggtcctaactaaacacaggatggggctctataaggtcctccttcttccttgactgttgataaggcttgtcaggtatggtcccagtgctggttgaattaagaggacagcatttattagcccttccccctatccttgaactcttaacatacctcctgctccctcttccataatattccttagagggagtggtctaagtaaatgactgattcatggctgggcccacagctgtcacttatagtctgtatcttgggcagctgtgcatgtctgcattcaccattgctcattgttaggaggcgattgtctgattaatgctggagatccttgtgtctatgggtgtaaagagaggtacttagaaggtgtttgttcctgtctgctaagttaaccatcagcaacacactctctgcatgggcatacttcctcttcagacctaagctgttagctaggttcatactactaggtattgtgtgcccctcttcccacctgcctcatgctgagtgggtcttgaatccattctgagggtgttagcgttctgtctaaactctactccacagttacctggcaacagccaggtatgctccaccccacagttacctggcaacagccaggtagacgacccactataaaaggggctgcttgtcctctcccctctctcttgcctctctctcttgctatcttgcctctccctcttgctcccccctttccccattcccttcacctcctttccatgtggtcatggccagcctctacttccctactctctccctctttctgcctttctctgcctctactaccctcttaactccccctattcgctgaataaactctattctatactataccatcttgtggctggtccctcggtagggggcaggagggaagggatgccttggcatgggcctgctgagacattcccttcccccatacctcaccacaccccagtagaatatatcttatacctttttatctttttataaaacacatcagagagttaattggttacatcccaaggtgctatcacacaaatggaaatatcttgctttccaagtggtttctttatatattctctttgtctgtgttaagtgttttcccactcacatcctcacttctccaatcttgcctctccatccctgcctaaagctttgcatacatggtgtactcttttagtgtgggagctgggtagaacagcaatgaacatgtatgtgcacatagtaaggcacaaaatctcacatgcctcggagggatatagctgagtcatatgctagtttttagtgtttgaagaagactgatttccaaagttgatatactctgttacattcccaccaataatatagaagagttctccttctcctaacatctgcattagcatttgttgttactgatattcccagtgactgactgggttgtggtgaaatgctgacgtcattttaaactgaattcccttaatggctaaggtgtttccttgccatttgtccatttgaatgtttcttttctttttttttttattattattttcttttattttagatctatcatttatttgtttgcttgtttaattttctgtgtatagatgttttgcctgagtgcatcttgtgtgtgtgtgtgtgtgtgtgtgtgtgtgtgtgtgtgtgtgatgactaaggagtctagaaggttgtgactgctatgtgggttctaagaaatatcacagatcctctgcaagagcaacaagtgttcttaaccattgagtgacctctccagcccctacaggtttggatttgttgttgttcttttgttttgtttttttttccttttgagaactttctctttagttctgtagcccattttcaaattgggttgttttcttggtatgtagtgttttgaattctttgtgtatttttaaaattaatttacttatttattttatacttattcacattatattctactcactgcccacctctcagtcaacccctccaacagtccttcccccatgcccccctcctcttctcctctgaccaggtggggtaccctcggatatgcccccaccctggcacttaaagtatctgaaaggctaggtgcttcctttcccactgagaccagacaaggtagcctagctagaagaacatatcccatggacagacaacagcttttgggatagcccccactctagttgtttgggacccacatgaagaccatacagcacatctgctacatatatgcagggaggactaggtccagcccatgtatattttttggttggtggctcattctctgagagccccaagggtccaggttagttgactctgttggtcattctgtggaattcctatcccattaggagctgtaattcttctcctgctcttccataaaagttcccaagctccatccactctttggctgtgggtgtctgcatctatataagtcagttggtgggtggagcctctcagaggacagttatgctagattcttgtctgaaagcataataaaatatcattaatagtgccagggattggttcttgaccatgggatgggtctcaagttgggctggttattgtttggccattccctcagtctctgctccatccccagtctctgtatttcttgtagataggataagttttgggttgaaagttttgtgggtgagttggtgtccctatcactccagaggcagtctccccagacttcatattcccagtgctgtgagacacagctaaggaattcccccattgattcttgggtacctcacttatcccaggtctcagtctcttcctgaagatgctgcccacctcttccactcctctttgtgtattcccaacactagtcctcggtcagattatgtagagcaggcaaagattgcatcccattttatgggctgcctttcagttgaatgagtttcctttgctatttataagctttttaatttcatgaaatcccacgtggtgatttcttagttacttttcaatttctatgccaaaagaccatgaccgaggcaacttagaaaggaaaggcttatttggacttcaggttccagagggattgtggtctgtcatggcagagaagcagcaggcattgcagccgggacagcaagcaaaaagttcacttcttgaacagatagcaggaagcagagagaacaaactaggaatggtgtgagggtgtgaatcctcagagctttctcccagtgccatacttcctccagtaaggccacatctcctagacacccacaagcagcaccaggaactgggcaccaaatgttcaaatgccaaagcctatgggtggggaggggctttctcatttaaactaccatatcaggccttggtcttattttctgtgctttgggaatcgtattcagaatgtctttgcttatacctatatgttgaaggatatatatatatgctttcacatttgtagaatgttaaatcttatattggggtaactgatctatttgggatggattttgtacaatgggagaaaaaggaatctaatttccttcttctgaatgttcatatccaggtttaccagaaccacttgctgaaaatacttcccattttcaagtgttgtttctcagcatctttgtaggaaaccagataactgtattttcagggactgtatcttctcttctattgatagactactttagcttatgttctcattacttgtgttgaggacatgatttttggcatcttcctaactttgccatgtttactaatatcaccccatactctgttttaaagggtttgcctggtgatcctggttaccctggagaaccaggaagagatggtgaaaaggtaaaactttctacattgtgatgtgtctggttttattcttattaccataatctgtgctcctcttgatactggattataagtgaaattataattacttagtgtttgtattcctgccttcattacccattttttcccttttatgcactttcctttaaattttcttgcattgctctaaatcacagtgcagagaaaatgcatgggattgaatttgcattagaatgtcagtgcctttgctgtaagcatatatcaacaaatcttttaagaggaggtttgatctctattccagtgaggttctcttgaaaagtttagagctgtaaacttctaatttctcctctaaacattttccactttgtatgtaatcattgtttgtttatctgtgactaattcgttgtagttttcccattggatggacacagcctgattgaggtcatttatttagttacctttttaaaaagtgactctgaaagcctgtgtgaaacacagttaccctatttttagcatatcacaaaatatttagtcctccatgttctctgttctctaactgctttgtatcaaaaccaatctgaaaaaagattaaagcaaacttgagttatctagaagtcacatattttactgatgatttctctctaaactagatccaagttttagtttagactaaaagacataattggaataaagggagagatcaaatacttaaatgggattgtttctcagttagtaacttatgatgcacagtaactttcctagaacttgaagtgtgagagagaaatctattcttaagtcttggcccgaaaaataacaattgaatgttgttttcttcctttatgacaatgttgtcttcttcctttgtgacaaagcatgttgctgctaggaatctgtccagtgtattcagcttttaagaaagctagcaaggttaattcattttggtcaagattatataatcagtacatccaaggcaagatcaaaggtctttggcaggcttaagcaagtatctcattaacctatgttatactttccacttgatttctttatgaatgacgcatgagtctttatgaaactcaattgttacttgaggaaatctaaaccaccacgtcattcttactaattacatgttataacattgccttgaacagggtcaaaagggtgatattggcccacctggacctcccggacttgtaagtttttctcttacgaattcatttctcgaatttaacattgcgtcaacatttttgtacacaagctatacactccctaccagttcctcacagaacataaaaatctaagtcattatcaacttctactgccttagaagccattatagttttgtcttgtttaatcatccatgttaaccttaaagttgttatacggttctgcctctgtgttactttttcatagttaaggtccaaattacacattattgttttgcatgattgtcaactcgtttcttaagtaaccagtaggtggcgcaactgctgctttcaaagggttcagagaaaggattttgagggaaccagaaattggtggtttcccctgcagtgcttagggcaaacatggatttagtcctaataggtttgctcaacttgaaattgtctggttcacatttctctcctttccttagtgtgtactttctggggctctagataacaaatcagcaattgctataactgggaggaggtgatagtatagattttctatcatatttacattgattgtggaatttaagtcatgtatatttccaagtatatcaagaataaaaaagatcactgttgaggattaagtaatattttggattgaacttggctaattctctagacttaacactgcattgaatccacagtagtgaatgctgtaaaagttcttctatactcctgacatttcagttctccttaccctaatgagtctcagacagaaatacatagaaacctactaaacctaatgaggccatatgtataatagatattagataatttttatccactttcacttgtttccagttcaaaatcggttctccaaaaaataatctctttagaaaataagacaataaaatcaggagtagaaatggaacttttaagagtgtagcacacttttcctttcagatcattaccctcattttgtatcttaaaactttgaagtctcttcttgtttatgaatatttttatgtccattggacttaggtagagtgaaatatcatagttggctagcaagtattaatttgtatgctggatcaacttgaaattctttatttttgtgaaattctttagaacacaaataagctatgagaggatgtagaagataggggtattcctcaaagggatggggcattttcaaagaagagtgtgagctgcagatgtttggaagacatctgtaaagggcactggtgaaaatgtgcacattgtgtgaagtggttataaccagatagccttgagagatatgaagtcattgctaaaaataatagggaaagaaataagaaagagtgatactgaaggaagtggtttgaccaagtttagggttccaagtagtatcgcatacagaaagtaggcaagtaatgtccttaggagaaatgtttacatagaaaagttgatttgaggaaattagcttaatgtgtgagatgaggacagaaattgtggtggttttagaaagaattgcagggcttcaggtgactggaatattatgaataatatgagaagagacagcaaaacacacgtctagctttgtaagccttgggcttaatattgtagggattacatgtttcctaattggttgagggtcaaagtgatagaggtgattactatgtaacagccttaaggagactcagtgtgatggctttcaggatttcctatctaaggactgtgtgaaaataaagcattataaccacatgtagctgcttagttacacttcgaagaacaagctacttcttcactgaattcctgaactccttttccataaaaaggtaattcctgcacctggaactggtgtgactatgggagaaaaaggaaatatcgggttacctggtttgcctggagaaaagggagagcgaggatttcctggaatacaaggtccacctggctttcctggacctccaggtaaaagacatgatggttatatctctatgcttacatagccaatccatacatacaattatttgatgtgacaactttattaattctgtgaggtttcagaaatacatacaacatacttttattatattagaaccaattttacattttacaatgaatataaaatcttgaccactcttacttattatttccagtgaagtgaacaatttcttgctcctattctaattactatacaattattttgtttcttttttaatagatattttgtttatttacagttcaaatgttattccctttcctggtttccactctggaacccccatcccatcctccctcttcctgcctctatgagggtgctaccccacccacccacccactcatgtcttcttgcctttgcattcccctacacgggggcatcgagctatgtgagaacccagctatacaactcctgagcatatacccaaaagatgctccaacatataacaaggacacatgcttccaacatataacaaggacacatactccacactatgttcatagcagccttatttataatagccagaagctggaaagaatccagactccctcaacagaggaatagatacagaaaatgtggttcatttacacaatggaatactactcagctattaaagacaatgactttatgaaattcttaggcaaatggatggaactagagaatatcatcctgagtgaggtaacccatacatacaattttatcatattggtttgactgggcatgacagtggatgatgtgaatggttcaggcttcacaccttgtatgtttgtgtatgataaatgtctgtgtggggatgaactcacccatgtgagtaccggtggaggccataatttgacattgaaaagtctttctacacttttttttcctcattaagcaagtctactcttgctggtcagttagcccccacaatctgtctgtgtcaccagaatggaagttatattaccattattaccattccaggctcttaagtagtttctgtggatatgacctcaggtccttatgttttcctaaaaaccctttacacacttaccccattccaaatgaggactttctaaataaccaagtataccaaagctgtattgtgtttcacaacaaattcttcacatgtacttttaaaagcttacttaaattttgtaaaaatcacttttaccttctattaaaaatatattgtgccgggcagtggtggcacatgcctttaatcccagcacttgggaggcaaaggtaggcgaatttctgagttcgaggccagcctggtctacatagtgagttccaggacagccagggctacacagagaaaccctgtctcaaccccccccccaaaaaaaaagaaaaaaaatattgtaccaaacaggtccttgatcctgtacatgaatcatcacacttttcattttgtcagaggacaggatactgacctaataaattactaacatttcttcatttcctatataacagtactaaccagaactgtccacttagaatcccagaatcaatgaattagaaatctgcgaggtgatttcaccacacaataaaactttaagactcagtgctgacttttatagctttcccttaccgggagctcttgactctagctgcatatgtatcaaaagatggcctagtcggccatcactgcaaagagaggcccattggacttgcagactttatatgccccagtacaggggaacgccagggccaaaaagggggagtgggtgggtaggggattggggggtgggtataagggacccttgggatagcattgaaaatgtaaacgaggaaaatacctaataaaaaataaataaataaacaaaaaaagttggctgcaaattaaaatgcccttatatatcctgttcattaagttatcagattttatgtaaacttcacagtagtgtctgtttcagtatctggcacacacatgtattcaatggattatagttcgttttcatgcaaaagtgtgtaactaaggaacagctgtcatgaggaagaaagtgacacctcccaagaaagaagctagtaagtgtgagtttcattatggtctaagtatgtgctttttattccttatctcaaataagtgaggtaaatgtttgttatgtcttgataattaacgtgaggcatttttccagaatacagtaagagctcaggagttgaataatataaaggaaaattataatgcacaggggatcagggaataagttgtatttcccaaaactatcatgtgagagtcgaagtacaaaagaacggggtgaggagcagtatttgaaaacaagtaatggctgtgatcttccacttacttaaagtacatgtttgtgcaagtgcacacatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaataactatgaattttggagcctatattctcctaaaccgccatcctggtatgaagatggaatagttaaaaggtttacctcctccagacatactggagagtaagggacaaattcaggataaagtaggggtgggaggtagggtaaaagaatcagggactaagaaagattgtaataactttgattaactcagttcataaaaatatgatttacataaaaacccaggactgtgtgtgtgaatattctttacatggtatgggcaaatacagagggaatgaggagttggccagtggtgcagttgttagtttttactattagtatgtgagaacataagcattatttactctaagcttttagagaaatacagatttaagggctttaggagtggttcagtggaacaaatgtttgctacacaaacatgaagacctaggtttgaatccctgacactgatataaaaatctagggacagtgtggtacatggcctcagagggaagagaggtggaggaaaagaaggagaaagaggaaaaatatagacttaaatacatagatcaacatgtataggtaccattattaagaagaatagaaataaaatgtacaatttatctccagttagaggaaaaaatagatcaatctatatagtagaaggtaaaattaaaacacagaaagataaacccagatgtatagaaaataaagtataagatgacacagaagatagtgaaaagtaaatcattaactccaacaaacataaagtgtgtatacttcgttccttcttagaattgggaacaaaatactcatggaaggagttacagagacaaagatcggagctaagactgaaggaaggaccatccagagactgccccacctggggatctatcccatatacaatcaccaaacccagacactattgcatattccagaaagattttgctgacatgaccctgatatagctatctcttgtgaagctatgcctgttcctggaaaatacagaagtggatgctcacagtcatcgattggatggaacacagggtccccaatgaaggaggtagagaatgtacccaaggagctaaaggggtctgcaaccctataggagtaacaacaatatgaactaaccagtaaccccagagctccttgggactaaaccaccaatcaaagaaaacacatggtgggactcatggctccagctgtatatgtagcagagaatggcgtagtcggtcaccaatgggagaagaggcccttggtcttgcaaagattctatgccagagtataggggaatgccagggccaggaattgggagtgggtgggttggggagcagggggagaggggagggtataggggattttccaaggaggaaactaggaaaggggatagcatttgaaatgtaaatgaagaaaatatctaacaaaaaaagaagttaaaaaaataaagaaaagataaatgatagatggtattaatgtaaaattgagataaaaaactgaaaaataaaataaaatactggtatagtatgcagaatatgtatatctgaagcagaaagaggaaacttgaaagtaggtgcaagaaatattaattaaatgatttatggaagaagaaagctatttaattctaatgtcaaatgaaagaaaattcaatgaaaaatgcattaatgactcagatattaataaatgatacagtgattaaagtcatgaacctttacacaactaatgaataaccttcagttatataataaaattgataagcttcagggggtcaattgacaggtccttaacacactgagtgtattaatatagcatataaataatttgaccaacattaataagctatatgttgaaagagagggaaactgttctaggaagcaaagaatatatattctttgtagatgtacatagaatataaaaatagactctttttttatttgaaaagaatctactgtgtgtatccttgtgtatgattctctatggctacagtaaaatagactggaaaaacatcaaatatccttataataatatttgtatggtgatgtagttaaaagtacttccagagataaagcaggcattatatgacaatgctaagccactaaatgctaagccacaataaaatgtgcttcatatcaaaactctttgactatagagcaaacagtacccccactctgtcaccagactacaaataccaaaattaagagagaaatatgaatgtagcccaggtaaaatgtacttgcattacacacacaaagaatgaggttgtatccctagaaacgataaagaagacaaaatgggctaaatttaactcacacacacaaacaaaaagaaacaagcacaaaatgtagaatggaacactttactaggatgaaaaaagtctgtaaagtgaaaactgaaacagatacagctcaacatggacactaaaatatgaaggtttaaactcacaaatggtaaaaactaaaattaataaagaaaaaaggatattgccataaatttttattgtaaggtattggaaaactataatatctacttatatatttaatattttagatgaaaaataaactctttaagcaagaaaacaaaattattaaagttgtgaataggaagtctaagtaagtcaattaacataggtaattttggaagattgaagatgtatatgaagaaatgttgatttacatgcacttttatagttttacggatgaattataccaaactgtaaaacacatccccatgttttgttttatttcaaggcataagtagaaaacctaataatactaatagcaaatcagccaaggaaaaacactgtaaataaaaattattcaatcttattcatgaacaaagtataataatgctaaattaaaattaccacttctctataaattatatatgatgttatcgctgtttaatttttcccaagatatcaaaaatgtttctatgttacattgctttaactgactacattaccaaaggatagaacaataaatgtatagaaattgatactagcaacaaacagtgaaatccactctttacagacctttgtaaaatatttgtgagtgggcctggagagatggttctgtggttggtagaactaactgctctgccagaggactcaaggttggttctcagcacctgcatggtggcttataactgctaactccagttccaaagaatctttttctctctttttacccttaaaggcaccagcacaaaaatggtgcacataaaatcatccagctttgcacacatacttatacatttaaaatatatagtcacagtgaataataaaaaattactaaaatatataccaagatacactttatgtaagagatcaataatttaaagtttattatattaagaactcatcctttaaattcctggccatcagatgccagattccaattggattttaaagagaaatttacaagtcattcttaaaattaattaagagtaaaactttaaatatagaaaataatttttaggggactggagaggtggctcagcagtgaagaacactgactgctcttctgaaggttctgagttcaagtcccagcaaccatatggtggctcacaaccatcataatgaaatccaatgccctcttctggggtgtctgaagacagctacagtataacatacatataataaataaataaatcttaaaaagaaaataatttttaaatgtataattatttcctgagtagttttgaaaaaaaacataaagtgtgtttatgtacaaaataggctgtgaggctgaaaaatgtccaggaatggagttacattttatttgatcatatttaagtacccattctctctttgccttttgacagtttcatatgtgtgtgtaatatactgtgattatattcagtctcatttacttttgtcatctcccttaatttacttttgagccccttcttcctaactagctctccccacccccagtgacaacactattaatgaaaagtaacaccactcatccatcaaccatcaacactccaaaggtcctcaggaaagaggagatccccgaagtactttcttttttcatgataaagtgctgaagggcccgtcttataaaaggatccatagctgctgtgtattccagatttgaaatggccatgtcatatctgaatggcagccttttgtggcacacctctatgttttttcatgcagccatagtttttgttaagctttctctctatccccataactactcccattcccctcccttaaaggaacgatatttctagggatagaacattatcatgtcaaattgagtgtattaatttattattaacttcaaaaattcataaaattgcttttgtttgttgatttttaagacagggtgtcaccatgtatggctatcatggaactcactagatcagactggtctcaaactcacagattcgccttcctttgtcacctgagtgctgggtttaaagttgtgcactaccaccaccgggctattactttgaataattgtgccttatactcaaagtgttacatcatttaaagaattcttccttgcaagtgttaattaccatagaaaaccttaagaccaaaaagaattgaacagggactaagttgggtaggaaggggtttaaaacatgagcagccagcaaatggggagaagaaagacaaaatagtgcacatcatctcttccatgcagaatctaatttagccttgtagaatgtgccatagaagcagaaagaagactgggtggataaatgagagtaaggaagggaaggacaagtgatggataaggtattgtggggtggatatgaacatatgtatatatggcataatgcaacccaatgttttgtttactaaaaatacagtttttttttaaaaatacaataaggaaatccaaccaatattatattaaaggcagattttatcattttatcttgtaattgtgtacaagataaggtcattttggtcactttatcatatactttttgtcatttaggaacagcagttgtgggtccccctggtcctcctggatatcctggtgaaaggggccagaaaggtgatgaaggtccccctggaatttgtattcctggatctcctggacttgatggacagcctggggctcctggccttccaggacctcctggcccccctggcccccagttgccatccagtaagccgtgcttttatcctgacatgcttggctgttgttctgctgtacgtcatttagaagtgaatctgactgaagtttgacatcgttatttatgttcctgatatctaagagattatactgttgtttttagtttgtggttttggtcattcgtcttcaaaccgtgttgattattaacaatatgttgccatattgcttattgagttgtatttttacagagaaataattgaaaataagtatttttctagcctttctgaggttttttttcctctagtcttctcaatgcttaacgataattaacttgctattttatctttaacctcaggagatgaaatctgtaaagcaggccctcctgggcctccaggacctccaggtgataaaggactccaaggagagcgaggagtaaaaggtttgatcccaaacatcttctcattctttaacatcattagtggaatgccctgcatctaacttctatcttaaaaaagctattcccatatcatctccttaaaaatagtgtatatttttgtaatgttggtttcatatctcagctctttttagcttacaacttctaataacttgactccagcacacctcccattgagacttactttagattagccatagcttaatggtatattttctttcctcttaattttccttaaattagcatgaccactcattgaaatcaactctattattaagcttgactcatttatttcctcacttccttttatttgtttggaactaaggtttagcatctttctctctctctctctctctctctctctctctctctctctctctctctctctcatttttttcaagactgggtttctctgtatagccctatctatcctggaactcattttgtagaccaaggtggcctcaaactcagaaatccacctgcctctgcctcccaagtgctgggactaaaggtgtgcgccacaactgcctggccttcttttctctttttatacttataggtaattatcactttaagattcttaacttgcttccttcttcattgacaaaataatagcaaacactctcaaggatctatggcaccacatactcagagataattacatttgtgcccaggcagtaccttcttaactaattatagttactgtttgttcttgaagcctggtagtctgggtggcctcctgtttccctaagagttttgattaaaaaattcttacctagtatttccaggaaagttaattaccatagtataaaccttgttcttcacgggaagcaaaacaaaccgatgaaaaatatagaagctctatttgaataaaaatgctggataagtcatctagcagacagacatgacagatgaaaatgtaaccatcttatctaatgtacaatatattactacatagaggactgtggtaataagttagtagtatcgtgcagctgccttgtaagagtatatttttgtcttgatgaaattggttggggctggaaatcaacatataagtggctaataatattaacgacaaagggatcaatagtggtcactagagttgaaaaataacaatggttttctattggcattagtcttgctttaattttacatggaaattctaatgtacatgattatttacttttgttttgttttataagagtttcttacatttctacctatttatggtagactgaagttagtgttaagtggtagtgttgagtttgggattatattaaggtttgattgggtcttttgtggcattagtttttttgtttgtttgtttgtttgttttaggagtgatgctagcatttgcctattctacagcagtatcagtagaaaggaattcagacctgtgatacactatttgaattattgaaggtgttaatggtggcttttgatagagttaattagagttgtattattaacaaattatgaggtagggttttttgttgaatttgataatattagaaattgaataattcccttcctgtcggcaccggcatcgggtcaccttgggcgcagagtcagcggacacccccaaggtccctagaggactctccacgtgatcttaggaccactagtgagtggaacacaacttctgttccaatccaatcacgcgggacctgagacagcattagggaagcagaaaaccagcctgaccagggtcacaagtcccttccggttggcgccagtacctggtaacattgtgctcagagttggcagaccccccacggtccctagaggactcttcacgtgatcttcggaccactgaccagaaagctccacactcctcaaaggagacaccacttccaggaactgtaacacgaccaggatctttgacagcaggatcccaggataaaaggagcttggtcacaccagtatttcagggtctcagaggaacttgactgccaagaactctgacataaccagaatctcaggttcacaggagcccacaagcaaaggatcacagagaaaactggactctgaggagtcctgaattaactgggattatagggaggagaggctccaataagatatattgaggacatcaaatacttgagataatcagatgggaggaggcaagcataagaacagaagcaatagaaaccaaggttacttggcatcatcagaaccaaactctcccaccatagcaagtcctggatacaccatcacaccagaaaagcaagacatggatctaaagtcacttcttatgatgatgatagagggagttaagaaggaaatacaggaaaacacaggtaaacagctagaaacctttcaagaggaaacacaaaaatgccttagagagttaaaggaaaactaaaacaaacagaagatggaattgaacaaaaccatccaggatctaaaaatggaaaaagaaacaataaagaaaacccaaagggaaacaactctggagatagaaaccctaggaaagaaatcaggaaccatagatatgagcatcagcaacagaatacaagagatggaagagagaatctcaggtgcaaaagattccatagggaatagggacacaacaataaaagaaaatcaaaatgcaaaaagatcctaaatcaaaacatccaggaaatccaggacacaatgagaagaccaaacctatggataataggagtagatgagaatgaagattttcaacttaaagggccagcaaatattttcaacaaaattatagaggaaaactatccatacctaaaaaaagagatgcccatgaacatacaagaagcctacagaactccaaatagactgggccagaaaagaaatccctcccgacacataatactcagaacaaatgcactaaataaagacaaaatattaaaagtagcaaggggaaaaggtcaaataacatataaaggcaggcctattggaattactccagacttctcaccagaaactatgaaagccagaagatccagaagagatgttatatagaccctaagagaacacaaatgccagcccaggctactatacccaacaaaactctcaattaccatagatggagaaaccaaagaattccgtgataaaaccaaattcacacaatatatttccacaaatccagcccttcaaagaataataaagggaaaacaccaacacaaggacagaaactataccctagaaaaagcaagaaagaaatccttcaacaaacctaaaagaagacagccacaagaacggaatgccaactctaacaacaaaaataataggaagcaacaattacttttccttaatatctcttaatatcaatggactcaattccccaataaaaagacatagactaacagactggctacacaaacagaacccaacattctgctgcttacaggaaacccatctcagagaaaaagacagaaactccctcaaagtgaaaggctggaaaacaattttccaagcaaacggtctgaagaaacaagctggagtagccattctttttttttaagagttatgaatttattagtattttatttttttaattttttaaaaattttttattacgtatttcctcaattannnnnnnnnnnnnnnnnnnncactttttggccctggcgttcccctgtactggggaatataaagtttgcatgcccaatgggcctctgtttccagtgatggccaactaggccatcttttgatacatatgcagctagagtcaagagctccggggtactgcttagttcataatgttgttccacctaaagggttgcagatctctttagctccttggatactttctctagctcctccattgggggagctgtgctccatccaatagctgactgtgagcatccacttatgtgtttgctaggccctggcctagtatcacaagagacagctatatcagggtcctttcagcaaacacttgctagtgtatgcaatggtgtcagcgtttggaggctaattatgggagtagccattctaatatcaaataaaatcaacttccaacccaaagttatcaaaaaagacaaggaggtggcacttcatactaatcaaaggtaaaatcttccaagaggaactctcaattctgaatatctatgctctaaatgcaagggcagccacactcattaaagaaactttagtaaagatcaaagtacacattgcacctcacacaataatagtgggagacttcaacacatcactttcatcaatggacagatcatggaaacagaaactaaacagggccagattgaaactaacagaagttatgaaacaaatggatttaacagatatctgcagaaagttttatcctaaaacaaaaggatatacctacttctcagcacctcatggtaccgtctctaaaattgaccatataattggtcacaaaacaggcctcaacagatacaaaaatattgaaattgtcccatgcatcctatcagatcaccatggactaaggctgctcttcaataacaacataaattatagaaagccagcaataatgtggaaactgatcaatactctcctcaatgataactttgtcaagggaggtataaggaaagaaattaaagactttttagagtttaatgaaaatgaagccacaacatatacaaatttatgggaaacaatgatagcatttctaagaggaaaactcatagctctgagtgcctccaaaaagaaactagagagatcacacactagcagcttgacaacaaaactaaaagctctagaactaaaggaagcaaattcacccaagaggagtagatggcaggaaataatcaaactcaggggcaaaatcaacgaagtagaaacagtagaaacaagaagaactattcaaagaatcaaccaaatgaggagctttttctttgagaaaatcaacaagatagataaacccttagccagacacactagagggcacagggacagcatcctaattaacaaaatcagaaatgaaaaaggagacataacaacagatcctgaagaaatccaaaacaccatcagatccttctacaaaaggctgtattcaacaaaactggaaaacatggatgaaatgaaccaatttctagacagataccaggtaccaaagttaaatcatgatcagagtaatgacctaaacagtcctatatccactaacgaaatagaagcagtcatcaatagtctcccaaccaaaaaaagcccaggaccagatgggtttagtgcagagttctatcagaccttcaaagaagatctaattccagttcttctcaaactattccacaaaatagaaacagaaggtactctacccaatgcattctatgaagtcacaattactctgatatctaaaccacagaattacccaaaaaagatagaggacttcagaccaatttcccttatgaatatcgatgcaaaaatcctcaataaagttcttgctaaccgaatccaagaacacatcaaaacaatcatccatcctgtccaagtaggtttcattccagacatgcagggatggtttaatatatggaaatccatcaacgtaatccactgtatatacaaactcaaagacaaaaaccacattgtcatctcgttaagtgctgagaaagcatttgacaaaatccaacacccattcatgataaaagacatggaaagatcaggaattcaaggcccacccctaaacatgataaaagcaatctacagcaaaccagtagccagcatcaaggtaaatggtgagaatctggaagtaatcccactaaaatcagggactagacaaggctgccactttctccctacctatacaatatagtacttgaagttctagtcagaacaacttgacaacaaaaggacatcatggggatacagattggaaaggaagaagtcaaaatatcagtatttgcagatgatatgatagtatatataagtgacctcaaaaattctaccagagaactcctaaacctgataaacagcttcagtgcagcagctggatataaaattaactcaaacaagtcaatggcctttctctacacaaaggataaacaggctgagaaagaaattagggaaacaacacccttcacaatagtcacaaataatataaaataccttggtgtgactgtaactaaggaagtgaaagatctgtatgataagaccttcaagtctctgaagaaagaaatcaaagaacaactcagaagatggaaagatctcccacgttcatggattggcaggatcaatatagtaaattttgctaccttgccaaaagcaatctaaagattcaatgcaatccccatcaaaattccaactcaattcttcaaggaattagaaagggcaatttgcaaattcatctggaataacaaaaaaaaaaatctaggatagccaaaaaaaaaaaaaaacaaaaacaaaaacaaaacacacacacacaaacaaaaaacaaaaaacctcttctcaatgataaaagaacctctggtggaatcaccatgcctgacctaaagcattactaaagaacaattgtgataaaaactgcatggtactggcataacaacactcaagtagaccaatggaatagaactgaagacccaaaaatgaacccacacacctatggtcacttgatctttgacaagggagctaaaaccatacagtgggaaaaagacagcattttcaacaaatggtgctggcacaactggcggttatcatgtagaaggatgcgaattgatccattcctatctccttgtactaaagtcaaatctaagtggatcaaggaacttcacataaaaccagagacactgaaacttatagaggagaaagtggggaaaagcctcgaaggtatgggcataggggaaaaattcctgaatagaacagcaatggcttgtgctgtaagatcaagaatcgacaaatgggacctcataaaattgcaaagcttctgtaaggcaaaagacaataagacaaaaaggccaccaatagattgagaaaggatctttaccaatcctaaatcagatagggaataatatccaatatatataaagaactcaagaaagtggactccagtaaatcaaataaccccattaaatatagggcttagagctaaacaaagaattcttgcctgaggaatatcaaatggctgagaagcacctgaaaaaatgttcagcatccttaatcataagggaaatgcaaatcaaaacaaccttgagattccacctcacaccagtcagaatggctaagatcaaaaattcaggtgacagcagatgctggcaaggatgtggagaaagaggaacactcctccactgctggtggaattgcaagcttgtacaaccactctggaaatcagtctggcggttcctcagaaaactggacatagtactaccagagtttctagtgatacctctcctgggcatatatctagaaggtgttccaactggtaagaaggacacaggctccactatgttcatagcagccttattcataatagccagaagctggaaagaacccatatgtccctcaacagagaaattgatacagacaatgtacatttacacaatggagtactactcagctattaaaaagaatgaatctatgaaattcctacgcaaatggatggacctggaaggtatcatcctaagtgaggtaacccaatcacaaaagaacgtacatgatatgtactcactgataagtggatattagcccagaatcttagaatacccaagatacaagttggaaaacacatgaaactcaagaagaaggaagaccaaagtgtggtcactttgccccttcttagaactgggaacaaaacacccatggaaggagttacagagaaaaagtttggagctgagatgaaaggatggaccatctagagactgctgcacccagggatctatcccataatcagcctccaaatgcagacaccattgcttaggccagcaagattttgctgaaaggaccctgataatgctgtctcttgtgatggtatgctggtgcctggcaaaccagaagtggatgcttacagtcagctattggatggaacacaggtcccccaatggaggagctagagaaagtacccaaggatctaaagggaactgcaaccctataggtggaacatcaatatgaactaaccagtacccccctggagctcgtgtctctagttgtatatgtagcagaagatggcctagttggccatcactggaaagagaggccccttggtcttgcaaactttatatgccccagtacaggggaacaccagggccaaaaagtgggaatgggtgggtaggggagttgggggtgagggtatgggggacttttgggatagcattggaaatgtaaatgaaataaatacccaataaaaaataatgagagttgttttcttaaaattaattaatgcaaagaatccagactatcgaaaatgttgaagaggaggattcatgtgtggtatatagtagttgggagagggaaaagaatatgatgaaaatatactgcatgagccaggcatggtggcacatgcctttgatcccagcacttggaggcaggcagatttctgagttcgaggccaccctggtctacagagggagttctaggacagccagtgctatacagagaaaatctggcttgaaaaactaaacaagaagaaaactgtatgaaaaattaaataagtaaataatatgaatagcttaccaagtaagggtagatgatatagctagatttgtaagattgccacaaattcttctagggtgatgaaggtagagtagggtaggatagtttgtaaatctttaagcaaaatatatagtgaattcccttgtagtattaaagaccaaataaccagtggcatatgcctaacatatgaatgtgcaagtcattattttaagtctgcttgtgggaaaatggagtctgttataatgatggctcttctgttaaatacccacctgcttttcatataaatcacagtgaaagctacatgttaatgtggcttgtatgtttcaccataagtcattcatttcactttaaatctataatttggccctacttccttattccatttcagcagactgatctatgggccattcattgcctatatgtagcatatatatgctatacttcttatgcaaatgccatgcctttcattttgtttatgtagacatcttgtcaatgagatctatcctgacctaaccctatttaaaatctttctcccacctaagcctccgcagcacacactcagtcacacctaagtccattttccctgtacaaatgtattttaatatacaattaaaagcttactggatttaacactatattaaactatttaaagtgtaatttaataatttgtcatctttactgtttattatttttattggtaggaagttagcttcacaaaagcatggaattttgtctattttctatattggcatgtcacaaatgcttaaagttgttctttatatatactaggcactcagtatttgtctaaaatttaattttagacaggcttctctaatcacagtggtgggtaggaatgctattattccctacagctgacttctttagaatcccatcaaaagaaagtttaagtaatccttccaataatatttgtttttttgccaggtgacaaaggtgatacttgcttcaactgtattggaactggcatttcagggcctccaggccaacctggtttaccaggtctcccaggtcctccaggtaaaatatcctccatatagtcaatcttttaaaatactttggttcttttgagcatgctaattgttttatgatgttactttgccatttttagctagtcacttatgtctagaaatttttgagtatgaaatgcctctcttatgaaataaattgcacttgtgtatgtaactggaagttaccaacattctctatcacagtatttggcattattcaaagaattacattttctcaaaagtgaaatgacatttagagtcagaattttgttctagaaaactagggagaatattcatactttctggaccatgagtatggtttccagatgcagagtcataggaatatatttcatattgtcattaaggaacaaggtttctattaaacttctggcaaccaactgccaatattccttgtacatatatggcttccctcctaattttgaatcatttctcagaatcacaaccattctactccattagctctttacatatgctaatattgcatattcttgagtttatatataaaatgtgtgtccaggctgatgatagactccagactgattaccagtctagtacatgtatcaatgacacaaagtcataagaagttaggaaacaccttaagcaagcttcatagctgccactaggagctagtaacatagctgtaaataatgcagttagtgcaaagattcgcctgtataactgatgcttcagtaacttttttcctgtaatgtttggtactaaacatctctgaaaacaaatcttaaggaatgaccaaccaaagaaagagctaggaaagatataggaagattgtataactgagggtgggtagggaagtggggggaagggtatgggggacttttgggatagcattctaaatgtaattgaggaaaatacgtaataataaaaaatattaaaaataaagaaaataaagataagcaggctcctttcctgtcttctcccagtggcagtaggatggggataagaactcatgcccaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctgacctatgtgtgtcttaggatctcttggaatccctggagagaagggggacaaaggacaagctgggataactggtccgaaaggattgccagtaagctttgattattttattatgagccacaaagtactgaaagatgcatgtgtcctttgatttttcacttatgaacagatacatataaatttagtttaaattataatttattttattctttctctctctatgctttgctatccctttttattagatattttcttcttttacatttcaaatgctatcccgaaagtcccctataccctcccccacactgctcccctacccacccactcccacttcttggccctggcattcccctatactctggcatagagtctttgcaagaccaagagcctctcctcccatcgatgatcgactaggtcatcctatgctacatatacagctggagccatgagtcccaccatgtgttttctttgatggtttagtcccagggagctctggggttactggttagttcatattgttgttactcctatatcgctgcagaccccttcagctccttgggtacattctctagctccttcactggggaccctgtgttccatccaattgatgactgtgagcatccacttctgtatttgccaggcactagcatagcctcacaagagacagctatatcagggttatgtcagcaaaatcttgctggcatgtacaatagtgtctccgtttggtggctgattatgggttggatccctgggtggggtagtctctgggtggtccatcctttcatctcagctccaaactttgtctctgtaactccttccatgggtattttgttccccattctaaggagggatgaaatatccacactttggtcttcgttcttcttgagtttcatgtgttttgcaaattgtatcttgggtattctaagtttctgggctaatatccacttatcagtgagtgcatatcatgtgtgttcttttgtgattgggttacttctctaaggatgatatcctccagatccatccatttgcctaagaatttcataaattcattgtttttaatagctgagtagtattccattgtgtaaatgtaccacattttctgtattcattcctcagttgagggatgctttgctatccttaattcatatgctactttgtatggtaaatattattgtataggttaatggagcaaactggaggggaaaatgttagaaaatattctaacttactttttttttcttctcccacttttttcttcaaactcagggcatacctggacctccaggtgctccaggctttccagggtctaagggtgaccctggggatgtcctcactcttccaggaatgaaaggtgacaaaggagagttgggtttccctggagctccagggcttcctggtctacctggtagtcctggaaaggatggtttgccaggactccctggccccaaaggagagcctgtgagttggattaatatacttgcttttatgtcaaattgtcatttagtaatgtttcatacaggatgaagttctatgtcaatggtaaaacttgtactgggtttgtgtgaagtacctaaattcaattttcagtactctctaaccctcctaaagcaattggtaagttaaaataaaataggagcctattacatagatgaatactaatgcctaaaataatacgattttacagtgaaatggtacattgatactagagtttccttactgttttccttcagttctataaactccttattaactcagtatagtattgattattactaactatgattagatggagaggaagttaaaatgcttaggagtcagagagggattcattattctaaacatctgtgggaattttttaagcatgaaaaaacccaatttgttatatatatgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttactcatcttctcagcttataccactcactggaagatagcgttctgagatatttgttgaaggaggtaattagtgagtaagtaatcatagattcgataaaagaacgtaacccagttttagcataactttaaaaggcatacttatggctgagtcatgcccctgattgtatccatttagactaatctacatgacgttgttacaccaatgctttctgtcttaaacatttccattttcagggtggaattacttttaagggtgaaagaggtcctcctgggagcccaggtttaccaggtctcccaggaaatatgggacctacaggcccagttggttttgggcctccaggccccataggcgaaaaaggcatacaaggtgtggcaggaaatccaggccagccgggattaccaggtatgtttacctttgttgtcttttctattttaaaagtagacagacacatagacagatagacagacagatagatataaaaagtttaaaaaattcctgggaaatgtgtttctctagccatctatatgcttataggaagggaatagattgtttttgtttaaagtgagatttcttgttaacttagtctaagtttgtagtgttttttgtatttcgttcttgaatatatgttagtgtagttgtatccatgtaactgggaaggatatgcacataactattttattaatatttttgaaatgatattataattataaatttttctgccttacctttatccctctaactcctcccatctcacatgtaaccccttgctctctttccaagttaaatccctttacttcaaatattcttttacatatgtgtgtgttcctacatgtacattcctaaacacagcacacacacacatacacactcctaaatacataaaaacaacctgcttggtctgtatagcattacctttatgtatatgttttgagtgtcaaaaacatgcaccataattttggagacagggtccctcactgaacccggagttcattgatattgctaggctggctagccagtactatccaagataccctcaggatatgggttatgtggtgctatagctacagttttattcatattcagcaggcactttgctgatggagctaccatcccatcccaatttatgttctgatgctcaagggaaggagaagataggtgttccagatgaatgaggagatgtgggggggggaagagggagagatttttttcctatgttttttgttgttgttgtactatccacatcctcttctgttggatgataatggtccatattgtgcaaaggcagaccctccttccttaaagcactgatttaaattcctatgtcttctggaatcatgggccataggcataaagcagagataattattttatcagctatctaaatatcctttaatctagtcaccctgacatctaaagttagttatcaaacatcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgatcctggacttccaggccaaccaggcctgccaggaatacctggtagcaaaggagaaccaggtatccctgggattgggcctcctggaccacctggtcctaaaggtatgtaggatgaggtatggggcagtgtagattacctgattagtaagatactattctttcataatatagaacaaagtagatttaacttattttggtatatgccatttaaaatctgtaaatgaaaaagtcacattgggcctgcagagatggctcagtgactaagagcactgcctgctcttccagaagacaagagtttacttagcatctccatggcagctcctaaccactcttaactctctaagtataatggactcaatgctgtactctgttttgtttttttttaaggacactaggcacatacctggttcatgtacatacatgcagacaaaacacatttgcacataaaattgaaatgataaaaataaacattaaagaagaaaagtcattatatgcaccttaattttggagacaggatctctcactgaacctggagttcattttctaaaacagtctagtgatgaaactatctacatttgagggatgcaaaatgattcatatgctaaagaacatcatgggaattatgacatttgtgttcatcattgtattcttagagccttgaagagttcctggaagtgtaacaagaagtacatagatatgtattgaattaatagattctattaatcagaacagattcactatacacatatgcaatattttatcccaaataaaatacacccttgatttattgatatttttagtttttttctacagttgtgctttactcctcccagaatgtattcttatgaataacagggcagcacctttgggtgatgacagttccttaggtctcccttatttttttttaataaatgacagatttgatttcatgtgtgaatgcttatataacacatacagttgcatctagctcatctgtagaagtacatgttcggcattctgtcacattatgtcacaatgtaagcagaagggcaggtctgtatttatgtatggcattgattcactatatttaattctgatgtgttatatacttcaaaagagcatagtttcttctacagccatctaattaccccgtagaactgaaaggataagctgattgagagactctcagatgaatattagacttaattctaagtggtcatatacaatgttcctggacttttaacgtgtcagtgtataaagcatgtgtttagggagatgagaatgtgactacctatcttcaaatttattctttctatgggttaaaacaatggcttgctattttacaggttttccaggaattccgggacctccaggagctcctggggcccctggaagaatgggtccagatgggcctcctgggccaccaggcttcccaggaccaaaggtctgaaacaatttcttaaaggatatatttatttttattttttatgtgtatcagtgatttgtctgcatgtgtatatatgtgtagcacatgggtgcctggtgtggtgacggtggaggccaggagtggggctcagatgccctagagctgaagtcgcagacagttgttaactaccatgtgggtgctgggaatcgaacctgggttctctacaagagcactcaacttctgagccatctccagccccagtctagaacattttaaactagccctttttcacaaagacagtcttctctactgtccttcgatccagttcctattcgtcttagacattgtcccaagtctttattatattgataatacttagctatattttcatttaaaaataaccaatcccaaaccatctttaatagaacttaacacccagatccaaagtctctgacattgttttagactgctaggtttttggattacgtgaaagaatccaatgatcagcttggcctatgtttatgtagacaaacagtaacccatttcatacttttacatgtgtgatgattggtaagattgtgttggatatatcaagcccttcctgtattgtttcctctgttccaattccattaaatatacataaaccaaatcactgctatttggtaatactaataaataactccctttatatttttccactgtaacttatttaaccttaaacacttttcagtcagccttcagcaaactgctaaagcatgtaattatacctactcttcctgaattccgtgcttaaatgatctaatctcagtggatttcatccttattacttgttttcctcatggaaaaacagctgacagactctcataaaaaaaaaatgcatctcttttggcttgtttttatttcatgatgaacattttcaaataaacacaaaagcccaagaaatgatctaatgaactttgacagatgtgtcagtcaggtacaaaactgctaagattatagtaacacttccttgatcttttcctgtttttcaggaagggggtggtctcacttaacccaaatctcaagattacatcatttcacttacaaatgctttgccattcatatgtaactaaatgaaaattgtatgcagaaaccacaatgacattatactacttaagtcatgttaaaactaattctttgcattatctgatcctcagtcctcttcacattccctcacttgtgtagagtgtggtttaatcccttgttttcagttaacttttgtactttgaaaacaatccaactcatttaatttgctctcactaaaccctatttctgtcccttccagatattctctctaacacacccatcattttttaaatttgactatcctcttcttaatatggaagaaaaaatattactttgtattcgatgctttaaattctctgtagtaaatggtaagcgtcaggaaagtcacgggacttttccttgtgttttgtcatgtgtatgcttaagggagagccaggatttgggttacctgggccacctgggccaccaggattcccaggtttcaaaggaacacctggtccaaaaggtgatcgtggtttcccaggaccttcaggtcctccaggacgcactggcttggatgggctacctggaccaaaaggtatggaggctcttgctacttctcaatttgttttaaactttcattgatgttgaaacctttggaaaaggttatgggtaataagcaagctcactggaaagcccatgatgcctgtctgccactgttttaattttgtttatattccactagtttgtttgtttttttcatttgtcaaaacagaggatataattgcctcttgtcttttgatttacttgctttgtgtacttttttaatttaataattactccatgtaatttaaatttgaaagaattcactgacttagtattgaattacatgtgtatactatcagttactacttgtaggaatggatttttgccaaccttttcttaacaccaataataccacacatgttatttagatgtgtgcaggtacaatagcagattagagtagcaaaacttaatattctcagtaaaaggtaagaacgtctatgggtagtatgaaatgtctctctgtctgagctattttatactcctaccaacaatgaatgaagcacttgtttcatccaaccccttcccaactgtagttaaaacaaaaacaaaaacaaaaacaaaacaaaacaaaaagacaaacaaaaaaattcctgactttttctagcctggtagaagtcactttatcagtatactttaaaaacatttccaagctaggtgtggtggcacatgcctttaatcccagcactccggaggcagaggcaggcagatttctgagttcgaggccagcctggtctacaacgtgagttccaggacagccagggctatacagagaaaccctgtctcgaaaaaccaaaaaaaaaaaaaaaaacaaaaaacaaaaaaaactaaaaacaacaacaacaaaatttccattgcaaagttttcaaatgcacagaaagattacaaagaattatacattgaatggctatctgcctgctgcttagaccctatatatgatattttgtctcattcaaaaggatttttaaataaaatactgtagatgcaatagctagagatggagctctccaattgaaaacttgcctagtatatgaaaggacctggattcattcctcaatgccagaaatggaaatgttatatgtaatataaggtagaaaaggcaataccatgactgctatatgcacccatcactgatgttctatggtgaatgttttttttttcattttttattaggtatttagctcatttacatttccaatgctataccaaaaagtcccccatacccaccnnnnnnnnnnnnnnnnnnnnacccactccccctttttggccctggcgttcccctgtactggggcatataaagtttgcaagtccaatgggcctctctttcaagtgatggcctactaggccatcttatggtgaatgttttatgcatactttctcatttatctgtccatttatatatctctttatataatcatcaatttccttttgatgaatatcaaaaaagttgcaaaagtggtaatcttttccctaatactcttacaatcccaaagctgcctatgtgttttatttctatataaaatccacagatgtattgacaaacaaaatctaatatgatatattatgatatattccagggcttgggatgcagctcattggaaatgcattttcttgccatgctcaaagtcctggtacacacacacacacacacacacacacacacacacacacacacacgtccttattccagtttccaattagtgtgcaataaccataccaatatcattatgaagcttttgtctgtcctttaatccttgtatgtggaatcatgcaatatgcatgtttttagaaaaatatcctcattagtacttatttctagtaaattcttgaagatgccattgttaggatccctgggctgtgtcaagttgctgagtattatgagagaagctgttagaagagatctctgagtcttttgatggatatatgctttgagtatgcttgtacatatagctaagactagaattgtgctcataagtgtgttcacttgtttagacctttctccaacatatattgacactttaaaattcacactgatataacatttttagttattcatgattctccccaatattaacattttacttgctttgtggttgtgtcataattacaaatttaatttaatttctctgatgacataggatggccagatttttatccgctcttgtggattatttagacattcaaatatttgccagtttaaattgatggattgtgttgtgtcttaagttgaaggtgttcctagtacaccctgaatacttgtgtttttttagagcaaactcaggagtattttattcctgtgttggttacctatttgtatttctagagtatttcgatatagagttttgattttattgttttatttatgttacccattatcataattttgtgtcttctctaagaaataattacctgctaggcactatcaagacattctgacccatagtgtcattaatctctaatactttgtatttatatcatttattaaaaataaaagtcgaacagtagattatttggacatttctatcacatcaaatactatgtatagatgggctattttctgttcactcatttgattcactatcctttaactagtatcacattgtttacatggatatatatacatatgtatatatatatgacccaaaaaatacttttcttgttaaaaattttaaactatattatgtactttgcctttcttctcaacatagttcaaatgtatgtgtccctactctgagtgaattaactatgtatcattttagagccttattttccctgcttacagttgatatcccaatttctctactactttaaccttcttaaacttgatatctttttttttgttgttgttcttttttgggttttggtttttggtttttttcaagacagggtttctctgtatagccctgactgtcctggaactcactttgtagaccaggctggcctcaaactcagaaattcacctgcctctgcctcccaagtgctgggattaaaggcatacaccaccactacccagtgatgtctttaaatatataaaggaataggcttaaaataactagcttggctgatttgatttcactgtttaatttgcaaagaatagaattctcaggataaatattttggagaattgtctaaattaaatttatattcacaaatcgtattgagttgattttcattaaatatatatatatatataattataaggaaactataaactattattaataacatgacattttaaaattgtttttaaaaattcctacatattagtgagaaggctgggtgttgtcaattatccccatttataaatatgaatcatttcaatgagaatttaagtaataattcagaagcatttcatgtaactgatttaaaaccttagtatttaccaaatacacattaatgcaggttaaaatgccactgatattataagactggaaacctgtacaggaataagtttatagaatttcagcaattcttttttttaatattttttattacgtattttcctcaattacatttctaatgctatcccaaagtcccccataccctcccccccacttccctacccactcactcccactttttggccctggcgttcccctgtactggggcatataaagtttgcgtgtccaatgggcctctctttccagtgatggctgactaggccatcttttgatacatatgcagttagagtcaagagctccggggtactggttagttcataatgttgttccacctatagggttgcagatccctttagctccttgggtactttctctagctcctccattgggagtcctgtgatccatccaatagctgactgtgagcaaaatttcagatagaaaattgtgatgctataatgtccatcattaggtggtttttacttccaatcctcatctaattagtacatacagttgacattatgttgatgggtacaaaaataattctaggagacatctctgggaatttgtataaaacattctaaaaagcagtaatataatctctacacagcttcttccctggaagaatactgttgattgttcacttcccaatggttatgagggtagaattcctctaatatcaaaaccaggcagaaaaacaaacaaatagacaaaaaatacaatgaaaaatatctaagttataggccaaaatctctgaagaacaaataggtaagaatttttccaaacattagcacatcaaatgttacaatatataaaaagaaactctagcatgactttaatgaccatcaaggtcttcagaatacaagctgctttgacatctgagaagtattcagcataatttgctatttcaacagtccaaacaattacatctatgcacctgaaatactgttcaaattatttgatataattcaacatccatttctgaaaaaaatacttttagaaaattatgaattaaagaaaacctgttagccagcctatagactcatcatatggtgggttgaggcagatggatttcaggctactcagaagggcagtgaaaagccctgtttcagaaaagcaaaaaagccttgtcatcaatattgaaattccaaagctcctttttataatctactcttttattgtaagtcttatatcatttattaaaagcttaatcaagtatggttgatggtgaaatactgaatactttcctccaaaaaataggctacaacaaagagttgtttgccagaaaatttatcattatactagaaatatttagccattgttgtaagttaagacaaataaattaaaagcatagagattgaaaaggaagaaattatctattcatacatgatttgactttgcatttagaaaatcatcttacataaaacctttggaacagaaagttaattttacaatataagtattagggccactatacaaaacaaagtgaaggtttaccaattagaattagataaaaaataatatttaaaatagtaccaagtatcataatgttctgacatatgtatagttctaacaataagtgtagtatttatattttaaagaagtacaaaatataaatgtcataagccaaatataactaaataaagtgatatattatgccaatgtactggcaggcccaatttccttaagacagcagttctgtccaaatagactaattgtacccttaaggaaaacacagcagaaatttgtaattggtcaaacacttatgtggaaaagtgaataccttatagtagccaaattaaatgaagaaagtcctatgttagagagttcaaagtatttgatttgaagacttaaaacaatcttaaagtgactgatatatcttgtaatatatgacatactgacacatgggtctaaaaatagaattgtctttgattttttgtgtgtgcagagctggagataaaatccaagcactcttgtattctaagcatatgctgaggtaaattctatcttcacaaaaatgtttctcataaattgaaagtacaatagaaaaagaaacttctaacaaatagtacaaaaactattattgtataggtgaccatgaaacaagcaaacaaaacaagtgaacctccaaattttccaaattttaactccaaacagattgtagacccacacataaagcttcaaaccctcacgcttctagaatgcaagcactgcaagtttttctggtaaaagtcaaagggaatcttttagatttagcagaggacattttttgttttacaagttctccttttggatatgtcatctgcttctctcatcaatgcaacaaaataactgacaaaagaaacttagagaagaatttctttcccttcagagttctagggcacagagcatcaagaaggagatggcttgagagcaagagcttaaggcagctcttcctatcacatccatagttaggaagcaaagaaagatgaacatttgtacttggttcattttctcctagtcacaagcagggaccagagcccactgaatagtgtcagccacttttagggtggatcatctcaccacagtctaatctaaataattccctacaggcctgtttagaggcttggctctaaatcctgttaggttgataatcaatattaagtaccatgtgattcaaaaataaaactaattctcagctcatagatagtgtaaacactggtgtatagtcaaattcagtttttttttaagtgaaagcatagaacaaaaatctttatgatcatatcctagacaaagaattgtttgctaggacacaaaagctcataaaaatggaaaactgctaatttggacttcactaaaataaaatattttcattttatgtgtctaacaaattatttgtaagcataatatatacaaatcctcaaaactcaacagtcagaaaccatttaccaaagttaaaagtagagttgaaaaatgttggcaacaatttaaatatatttatattttgccccacaaatcattcaaatgtcaagcaaatgcatgtaagattccatacagtcttctgcaaaatataggtttaagcaacaatgaaatagatagatagatagatagatagataatagatagatagatacatacatacatacatacatacatgcatgcatacatagatacatagataaactataagaattagctttcttctcaagaagaaaaattgccaagtatgtagactaatagagaactctacacagctagttagaatcccaaacagtgcagtcacttcaatctccagcacaggaccaaagagcttctgtccactttgaaaatgttgtgccagtgtattagaaagtaaaacagtcttgctctctgaaacagcaaactcacttctaggtatttattaaagaaaactctgaagctttgcataaaaatctgtaagtctatgttcataggagctttattcataatcaacaagaattgtaaaaagcccaaatgtccatcaaacaacaaggactaacacagtgtagagtatttatacaatgaaatattcaatatgtgctgttgggaatcaagtccaggacttcatgcatgctaaacatacgttctcactgctgacataaatcgtagcccaacatgtatctttcaaaaatttacacagtcaatttcagtaggaaaataaatcttttcaacaaacagtgctaaatatgattggatatatgtatacacaaccacacataaatgaatctcaaatgtatcacatttagtggggaaaaagacatactcaagaagctacatactgcatggttacatttgtgacattctggaaatagaaaacctataagaaataaagtagcagagtagtcacaagattattggcatatggagaaggagcaacaactgatcgctggtccttttgaggattggtgaaatgattttaaatctggatttaatggcagttttacaaccgtacagatttctcaaaatgcatccaagtgtgtgatgaaagaacaggtttcaaaaaatacaatgtttgtattagttttttagaaattcatacatactctgtagttttctgactcttgcctataatgccctcaagatctatccttcacctctctgcgcctcccaattttacatcatcttaaaaagtaacccactaggtccaatgtgtatatctcacactcatgtctattagaacaggaacaacataccacaggccacacccttaaagaaaactgactttaccttccctagaagccatcaactaccaatacctcctctactagaaatggaggtacatgagacacacacacacacacacacacacaccacacacacacacacacacacacacacacacacacacatacacatacacacacacacacacacacacacacatacacatacacacacacacacacacacacacacacacacacacaccccttaagcaggacaattgattgatttgatcgtgtgcaggcaactacagctactattgagtatctaagtgcagttgtcgggtcatatctagaagacaccgattttctctggattttcctaacttctggctcttacattcactcccactcctgttcctcaatgatccctaagcaaatcttaatagatgtgataagtttgaaaagtgtgagtgataggaaattcagagagtaaagtatcaactgtcaaaatattgtaggcaagagcatattttcagctagaacctcaagttaataaaaagaaagatgttgctgtctatctgcttaaagctgaagtgattaaaaaatatttttataaccaaagagttatccagtatgaagtagactacaatcttgttgctgttttgagaagttaagacaagcactgacattgacttctggccttgtgttaaataagacttcaactatgaatgggatttcagctttgggtacttgtccttttcttcctggataaactagtcttattgcatccttttctaccttgtttggttgatgccccagggaggcctgctcttttctgaaggcaaagagaagagcagtgggtctgggtgaaagggaaggtactggaggagtggagggaggcaaaaactgctgtttgggatatattgtatgagagaagaataacagaaaaggaaaaaatatggttatatttaacatgtaaactgtgcttttttaaaaaggtgatgttggaccaaatggacaacctggcccagtagggcctccagggctgccaggaattggtcttcagggaccaccaggaccaccagggactccagggccaataggccaacctggtaagattacagtaaatgtgcctgctataagacttgcagtgtatatgattgtcttccagtaatgtgattaaagtggtaatccgtgtgtgtatatatatattttttatccaattgtaaactatagatcacatcataagagctaatttattacttgatgtttcccccttctgttcacctaaaaatccatttagtctagtaatgaaatttgataattgtacttaccattaccatataatcattgaacatacagagttttaaaaacagaactcaaactatttgtgcttattatttcagaccaaagaataaagtggatctctctttttttttctcctgtactgggaataactgtaattgagcatgcgctaagctgctctttcttcagttagatacttgaaacggtcttgtaacatgtagctcatggttttgcctccatggataaagaatcacatggctgttgtatatctgtatgagagtctgtagtaagtgtggattctgagtgaattcacattatctatttactccggtacagtaagggacattctcagccctgaatttcgttattttgaatattgtaatagttcataaaatgaaaacaaacatggaacattattttttaattcgtatgaacataacagaaagttgaacacaattcagatgcacatatattgaacacatgtattttctgaccttaaatgacaccagatatgttgttggtaattgccttaagagtttctaaactatggttaacaatataaaacacccataaaggctatttttatttgttcaccattttaaaactcaatttgaaggcacgttgtacttttttaaagccccctggcaagcattacataagaaaaacataagcaaacttgcagtcatgtttcgaacaaggttgctatagttgcctcatcattcatgaaaaaaagagcaaacaaaacaaaaacaaaaacaagctttttccaccatcttggctcctgtggaggcctgctgggaacaggacttctaacagcaagtatgtctagaaggctgtggtgcaaggccatttttgttggttccaagcaaggtctctggaactaaagagagcacacggctcttaagattgcaggcgtttatgcccaagatgaaacagagttctacttaggcaagacatgtgcttgtgtgtatgactcaaaaaacaaaacaaaacaaacaacaacaacaaaaaccaatacagcgactcctggaggcaaaccaaacaaacccagagtgatctggaaaaaagtacctgggctcacagaaacagtagaatggttcttgccaaattccaaagcaaccttcctgcagaggccattgtctacattgtggacattgtctacaaagtaaggagaaggcatcaaaaaagcccaagccaccctcattggtccacttaaatcttcagcaacaggcgctggagagtatcggaatccatctctatatgtgtttggttgatcttttttcattaagaaatctacacagaatcagtttgatgctgtatccatcccggatttaaacttatggagagtaaataagtaaaaatagattggtgctcttgtaaaaaaaaaacaaaaacaaaaacaaaaacaaaaaccactctgcccaacctgcatagaagtggaatcttgaagaaaaatgtatttttagttttgattattactgacttaaactgttatttcacaaacaacagtgtaatgattttatcacttcttttgcattttgttgtttcttttagtttgcaaaagtacatgacgctgtcgaagcattttgaattcttacatgagagctgcatggaaatttaaaacactgttaacaagcatctgaattaaaatataaaattgtaatatttatttaaaactatagctaataccttgcaattttttgtcaagacatctactattctatttctctactgcttttttccaactcccagtagcataaacactgcacaatatcaggacagtgctagttaataacttttaattcaccttcatgtatttgcttgtaaatattttctttgccatagacttttatatcaattgtattcagcagttaacaaaaaatataaaaattattcaatggactctcaatatatacattcattttaatataaatgttattatcatcaccaaaggaaaatattaatttaacactttttaactatattgactcttacatagaaggtcgatcagcaagaacactattatagtatcttgctagacctgcattataatgcatgacagaaacttccagtttacataatatacttgttttctgttgcatcaaaaatgcaataccaaataataacattaaatataaaacttaatttaaaataaaacttaaaatgagataatacaacagaaaacttaatacaaaatagtaagaactgattgtataattattaaaacgacatgttaagacaaagcctaaatcaaaccaaaacaaattgacttatttgataatcattcagaagggtcaacattatatgcacaaataattggtaatgtaatggaacagtgaaaatccacctgtggtcagcgggccaatgaatggcaaagcataagatgttaacaatggcaaagcataagatgttaacaatctacgatgagaaaaacattgagagtgtgcattcaaaaattttacaaatttgacaatttaaagctatgctcctatttattgaataatataaccagaaaactgagctttttttttttttcaaggtttggttaaggatatttgtacttaattaaaaagttagtcaaaaattaactggaattttttaaaaattgtgttttaaccaaaacaatttgagcaaaacctctcttccagaaatatgacttaaaatgttaaagtttggttttcattaatcattttcacatgcacgatggctaaagtttctgtaatgcactctcctaagtatatcatctgcagatcacgtcacttctttgatagaaaaataaccagatgtgtaatgtggagactgcatcaatacttacaatgttaatatgttgttaactaggcttacatgggattccaggagagaagggggacccaggacctcctgggtttgatgttccaggactccctggagagagaggtagtccagggctccctggagcccctggtcttataggacctccaggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattgacagtgcttagtattttgtttctttgggatgtgttaattgaaaagtgtcttcttttatattttttatgaaactgttaaagaataaaatgtattaataaatttaaaagataaaatatttaagaatatattatcattattattttagacattaataataataaaatgcctacagtttgttgactttacttttgaaaaaaatcacataaacattctttttaaaaattattttatttatttacatttcactttttgtcccccttccagtcctccctctcatggttcctcatcccattcctcctccccctttcccccaagagagtgctcccctcaccaggcatcatccttctctggggtctcaagtctttggtggattaagtgcattttctctcactgcagccagaacaggccagtgtatgctcctggttggtggttcagactctaccagctccctgagatctgtgttagttgagactgctggtcttcctgtggggttgcacttcccttcagcttcttcagtccttccccaaattcaaccacaggggtcctggacttcagtccaatggttgggtgtcagtatctgcttctgtctcagtcagctactggtagggcctctcagggaacagccatgctagacttttatcttcagtctcttctccattttgaacctgcagttctttttagacagcaacagttctgagtcaggaatattgactgtgagttagtaacccaattcccccacatgaggcccatgttcatagcagccttatttgtgatagccagaagctggtaatgtcttcttttcagtttgatgatatacttaatttgtatacctgaaacattgtaaatgcttaggccataatttcagaattgaacttcaggttttccttattgtgagtctgtaaacacattccagaaaggagataaattattacctgtgtttattaacatatatgcactcaagtaatttattgacagacattaggttagatacatgttttgaggcttagtttacctaagttatgagacatgtgataattttacatgcattgattatggatgaagaaatttggtgtgctttgttgactttaggtgatgatggcatgcaaggtcagccaggtctccctggccctgcaggagaaaagggcggtaagggagagcctggccttccaggtcctcctggaccaatgcatccagatttcctgggatcgaaaggagaaaagggtgagcccggcttaccaggtaagtgggtggatatattcacaaatatttttgcatatcttaggtttaatattttttaggttattttgttagttgtcctacaggcgaacaaatcatatggatactagcaaatgctctttcacacacagttcctgaagtttgattttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagagaagtaacttggagttactatgtttaacaagtcaattacatatgtgacattttggtagtgaatattttcatttcatttgtgttgtttcattgattacctttctgcttgaatattttctttgtcatatacctgtcatgagctatggggtttttaaagcagatttggggagctagggagttggctaagtgaattgcttgctatgcaagcatgaaactggagattggatccaccaaacccatataaaggcagcacaggcacctacctataatcagaacacttttgaggcagacatgggtgagcaaactctgggagatttttgagttcagtgagagacttgtcctcaaaaaacaaaaggctgagcaatctatgaagacatccaagttcaactttgggcctctgtgtgacctaagaaagacacatgggccaacaaacctatgagcatgtatatatacacatacatagatgcatatctaagtacatacattcataaataatatagacttaaataactaccttcaggcttccagaagtaccacagaagcatagaaagagaaaattatatatagccacaataatttgaggacagcaaatttggtatttaggaattgtggtggttctttttaattttattcacctagaaaccaaatgatgatgaatagtattatgctctatacaacaagttttaaattataaaaatattggtttcttatcctagaaatataatgtggtttatcaaaaaccacacacacacacacacacacacacacacacataaacacacacatatatatatggcacctatagaaaagaaacatactttttgaaaaagcacttgcaactttttgtgttctattattgctgtcagttgtaaatgtgtgtgtgtgtgcacatctctaaataaatgttatgggtttctcattgggcatgatttaatgaaatttttccttaaaattactttgtatgttaaagtttttctaaaagtaccaaaagaggtaaaatttaggataacaaaaatgaaatgtctttcttagttatctcttcttttaaaaaccagatctgattgactgattgattgatttggtgattaattgattgatacatatatatatatatatatatgctacagtacccatttgaattgcagaggacaaattatacttctcctactccactatgtgggctacaaagtttggactcagggcttcaggtttggtggcatgttcccttatcaagtgagcagttttatcagctcctggggttattgttattatctttcatcttttaaccaggctttgcaaattataggacagtaaaatatacttgacttgtactgtagagttaataatgataaaagacattgagacaggaacaaagagaaagttgactttatttggctgatctgaatttcttggtgggaaacagtaaacaaatgaagaaactaatagtttatactacatcaaattatcaccaatttggccagtgttattgttgatacaggtgagtagggccaggcattgaatattattttgttgctcttgtttgaagtgctgggggtcaaatctgatgattggatagttcttaccccatcattctccaggccatcttaagaattcatgatccatatctctatcaagtgagaggcaaacctccttagaagtgggaacaaaacacctttggaaggagttacagagacaaagtttggagctgagacgaaaggatggaccttgtagagactgccatatccagggatccaccccataatcagcatccaaacgctgacaccatcgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactactaactgcatatgtatcaaaagaggcctagtcannnnnnnnnnnnnnnnnnnnnnnnnnnnnnnnnnnnnnnnnnnnnnnnnnnnnnnnnnnnnnnnnnnnnnnnnnnnnnnnaacattttatcatccctagtacatcatcttgaagttgatgttcataggatctttttggtagtcatttcattttcatttgtcctgggaacttcatcttcttgatttgggaaatcaattggactgtcagaaaaagaccttgtcacagaacatagaattagggaaatagttaaagtgcagcagccttccaacacacacatacacatatggacacacatacatgcactcatacatacacacataaacacacactcacacatgcaccaagagagacagagacagagagatagacacacagagaggacagcagtttctccattttacttatatgcagttcaacagttaagcagctttctggcaaaatcatgtaatttattagtaagaatcagcctaacttgatttttatgcttgtctttggaaggtattcctggactttcaggaccaaaaggctaccagggattacctggagacccagggcaacctggactgagtggacaaccaggatcaccaggactcccaggtatgtaaaatacatcactgtggtacttagatgattgacaaagatcctgaggaagtatttatgtcattttacagtttagtgatgatttagatctgttcatgctaagtgcagctaggcttgacaaaattgttggcatgtgctccaagttttaacagataagatatataggatgttttattttgcttattcagattcatattttgctcacaacataatatatttagaactctgattcatgtaaggtgctatattttattacaaactctccaacatagaaagaaatacaattatcaggtagaagcctgaataattcacctgttccagttgttttgattctttgttaatatcagacaagtccataattctgcgatgtaaaacagattattgctattttaatttttaaaaattttaaggatgaacatttcacagccctccttgtagtctgttacagcccaaattctcttacaatgaacagggtttttttttaaatcctcatttttatcttaattctcataaaactttcagctgttttattttagttcatccccaaggaagtaaaaagccctgaaggccaactatgtgccatcttattcacataccacatcttgaaggagtcagaaagatggactcgctcctgatttcttcccaacatcttttgcattctccatctaaagctggaagtcactgtgaaagaaaaagaaaaacacatttatggtagcagtggtaaatgattaagtgacatcacacagctcaactcaagcacctgtgatgttaaaagtagaatcctcaaacacatccaggtcaatctagcatcttttcatcaacccaggagataggtctctctctctctctctctctctctctctctctctctctctctctctctctctctctctctctctctcctatcatagtgaggctctgtcatgacacaaacctactgctgaagttttattaaacattcttatattggatttatcagtgagaacagaaagtgggtagttatgtgcaacaaacagaacaccaaatgcatggaattagtttatgagaagaaccaagatgctcaataaaattgcctttatttttatgaggttgaatttaaagatctgtatttgcataattatattgcagtataatactaaacagacttctgagggacacattgctcattttgtactaagttatgtctgtagcctataacgcaatgcaattaatttttccaatgcaatgcatggtcccactactctgctttaattttatcaacattacttttctaggtcccaagggtaatcctggtctccctggtccaccaggacttacaggacctcctggaccaaaaggaaacattggtgacatgggttttcctggtgagtgatgaaaaagttaaagtcatttagtgctattaatagtcactattccccccctcccttgagacagggtctcatgtagcacagactatcattgaacttgctacatagctagtcctcctgtatctacccacaaactactgggattataagtgcttgacactataccatgtttataatgtacaaaagattgaacctacagctttattcatacaatgcaagcactctgccaattaacctatgacccaacctcctttttatcccctacctctttttacaatattttatttttattaattaatcttttatactccatattgtattcccctcaatccaccctccaactgttccatatctcatacctccttcccactcccctgtctccatgaggatgtccccaaccctcaccccacctgacctctaaactccatggggcctccagtcttttgatgattaggtgtatcatctctgaatgaacacagacctggaagtcctctcctgtatgtgtgctgggggcctcatatcagctggtgtatgctgtctgtttggtggtccagtgtttcagagatctgggagggagtgtccagattaattgagacagctggtcctcctacagggttgacctcagcagcttctgtccactttgggccttctttccctcaggttcctttccattttcatccctgttattctttcagacaggaacaattatgaatcagagatgtgactgtgggatggcaaccccatccctcacttgatagcctgtcttcctgctggaggtgggctctataatttccctctccctactgtccagtgtttcatctaaggtatctcgcctaccaggtctctggtatattctgtagccccgcccccccacaacctcctctttcctgaggttgcctgtttccattctttctgctggccctcagggctttagtcctttccctcacccaataccagatcaggttcacctccactcactttccctcccaggcccctccctccctccccacttgtgatgtgattgctttcttctccctcccaagtatgactgagacatcctcacttgggcatttcagcttgttgatctttttgagttctgtagactgtaccttgggtattctgtacttttttttttttttgctaatatccatttattagtgagtacataccatgcatgtccttttgagtctgaattacctcactcaggataatagtttctagttccatccatttgccagcaaaattcaggatgtcatggttcttaatagctgagtagtactccattgtgtaaatgaacgacattttctgtatccattcttctgttgtgggatatctaggttgtttccagcttccggctatcacaaacaaggccgctatgaatatagtggaacacgtgctgctgtggcatggcccccacctctttttatcagaaaagatgttaagtataaggtctgggtatgtagctaagtgatagtatatatgagccctgagcattgatagaatcatagtaagacactctctcaaataaccaatatatatatatatatcattacaaacagatatttaaagtaatgaagaacagaattttaagacattagaaagttagaattcacaagcacatgtgttctctagctttttttctttcatcaaaatttcttagaaataggttgttatgtaagcctgtgtgtgagggtcattatatatactcagtttgtggaattttttccaaagatagttctgctaggtcacattcatcttaggtttgacatgagtaaagcctatattatcaaataatatacaatgcatattttcaacaggccctcaaggtgtagatgggccccctggacctcctggatttcctggacaacctggctctcctgggttacctggccagaaaggaagtaaaggagagcctggggtttcaggcattggacttccaggtcttcctggcccaaaggtaatcctagtctgatcatgtgtctgagaagtttcagtttgtctttaactgtgctcatctctaattcttcactaaacaaaccacagaatgacaaggcatgttctgagcaaaggatgtattccttcccttttctcaataaataatcttttattgagtaatcaacaataatattgccgggcggtggtggtgcatgcctttaatcccagcacttgggaggcagaggcaggtagatttctgagttcgaggccagcctggtctacagagtgagttccaggacagccagagatacacagagaaaccctgtctcaaaaacaaaacaaaacaaacaaacaaaaaatacagtgctgggttttttctatgttcatcacctttcacatacatgctttaaactttctgtagtactatttggcctggccaagcagccttgcagtatgatttaacagtttcccctattgacttaatattcccttgattggacgagctaaatacatagaaaacttgaagcactcattttatactctctcatccttagttgttaagctgtcagtgttattcagcatgttcaaaacttcacttaagcaagatgagtaaagtctagcaatctctggtgcaatacagtaaatatggctaacagtattactcatcttaaaatgttcagattaattatatgtgctatgtagattaagtttggttggtttggtttggttttgctgttttcgatatgactttcactttgtagttgagactgtcctagaatttactatgtagcccaggctggtcttgaattctatatcctactacaccttagctttcccactactgggattataggcatacatcactatacccagctcttttaagcactgttattaaaaaatgtgtgcatgcacacaaacacactctcacatactcatttatgcacacacgcacacacacacacacacacacacacacacacacacacaagaaggagtgagaaagagaatattggcagtaactctgtttagattatatcatgattacatgcttgtatccagaaagtacgtatgcatttactatgtacaaatttttgcacgtaaagttaaatcatctttatcaattgactttcattggattttgatttacattttgcatctataagagaataataaataaataaataaacataatgttttgatttgtgtatacattggggagatagtttcccttaattttatttttattgtttgataatttcatgttgcatttttaatcaaataagcttccctgtttcttcctattatctcctaccaatttcttgttatttaaaaaaaatagtgagtttatttgtgcatgggtgatgtgccatatacttgatgggtaacttgatgggtaacctctcaggggctgcattattgaagaaagctggttcttcctctcccagcctccatgaattgccactagcaccattgcatggggtaggaagtcatgtccacacctcccatgctcatatgctccatgctgagattattgtctggctctattttgcacaagtcttgcacatgctgtcacaactgctgaagatcatgtgggtaactatcctgctgtgtccagaaaatagtgttaaatccctggttattttaaactatgttttagaaacatggagacttattcattatgttcactatgcagtgctatgtaacatgtaaatttatttcatctatctggcactaaatgcatacttggtgcccaaaccctctgccagcctcttgcatttattttccataatctgtggtaaccagcattctacacgtagcttatctttctctaattgatttcaatgaacgtaacataccctggctccatccctgttgtcatagtgacatgctgttttagagcttacttgtagtttagtgtgcagcatttcttttattcacttgtctgttggtggacacacattccagttattttcaatagagctgtggtaagcacgggagtgaaggtagtttattttctttgtgtacatagctaaaagcaggcctgctggatagtatagaagctctgcttgacaaatttttgttacctttcttggtctaaggtagaactaggacttatagtgtagtagtagtcatcagctatgtgtgtgtggctagagcaataaaaatgtatcactggatatggactataacttccaactgagggctaccactcagaaggatataggttttctcctatccaatgaaaaaatttccatttattgtttttggttttcctacttccattgcctcttcaattttaagatttcaggcaaaaagacagattagctttcccatttgctttgatattacttataaaatagggcaaactatagctatattttaaggacatagattgtagcatgaaagagaagatgctaatattgctaaggtatagtaaaggctgactttggtcaacctacttagtttgccagtttgaattttagcaagagaaaagatacgaaatggaattcctagtctgctcaaactatatgtgaaacaccataggatagggaccttacaaaaatcatagcaaagctgagtgtagaataaatgcaaaaaatttcagcttcactgtatcctagccttactaaaagcacaaattgattttaattttgtttttgttttcctatggagatgcacgagtttcctggtctgatcttttgattttcgggatcctcttctccttattccttaaaacttatctttttctgaaacacatagtctccccagtaaatattagataaagcttaagctagtaaatttaattcatttcagaaatctttataaagtgtttaaaatttacttgccaggagggtggtaaattgtttgaagagacacaggtaatacactttagagactggtatcacttgtagaatttggcatactttacttatcataaatagaagtgggttgggtaccttccaggtagtttgtccctaactgaatattagaatttctttctatgttttattttagtatataaatttaattcattcataaatacttaaggccctggaaggatgaagctttatgacagagcacttaggttatctgcataaatgtctaatgtgaaaccaatttcagccaagttgttagtagatacccattttgtatccccaaaatgtgctatatttataaaggttcagaaaaaatatatatatatacatgcttagcccaacatttttaaactgttaagaaaaaagtaaggaaatgggtcactaattaaaaaactattaccataatatagaaatacaaatgtttcaaatggcaaattttatttactcaagcaagtataagaaggagacattctgtagatggtattgaacactaatgtgctgttaaagaggctatgatcctcatgagcagagcagtgagtgctgaggtaggcgtttagaattatggtgcattgttttcatcagtatttaggaaaacttttaaaactgttaaagttcgtaggttcttctaagactgtattgaaagaaatataatgtaaatactcattgaggaaacatagcaacatgtacattgcctgttgccacaaagattttttttatgtgtagtattgttttcttttttattagatattttctttatttgcatttcaaatgttatcccctttcctagtttcctctccaaaaatcccctatccctcccccccccccactccccaacctacccactcctgcttcctggccctggcattcccctaaactagggtatacaaccttcacagaaccaaaggcctctcctcccactgatgaccgatcgactaggtcatcctctgctacatatgcagctagagacacgagttcaaccatgtgtactctttggttggtagtttagttccaagggagctctaggggtactggttagttcatgttgatgttccttctatgggactgcaaacccttcagctccttgggtactttttttagctccttcgttggggaacctgtgctcagtccaatggacagctgtgaacatccacttctgtatttgtcaggcactggcagagcctctcaggagacagctatatcagactcctgttagcaagctcttgttggcatccacaatagtgtctgggtttggtgggtttttatgggatggatccccaggtgggtcagtctctagatggtcatttcttcagtctctactccacgctttgtctctgtaaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcagggaaataaaaattaagagcattttctggtactactatgttgagccacattcatagctatttttggctacatgccacccatgatccacatagattgcttgtcaagaatgatttcatgatttatgacgattattagatatccactgaagaattggtggattgttcatggtaagataaaacccagccttttcactagaaccaagtgtagctactggcttaagcagtgcaacgcattaaagaatattttcatgaacactacaagttctaaagtcaaaattcaaactctactgcttgctaacagtatcactagaacattcagatggcaatgctttttcctaataggattggtaaggattagtgagagtgacatagccacaaagcacaggaatagcatgagctctggtatctgatagacttcgggccaaacgttaattctgctacttactgaagacttcaggctcttgacttctctgagatttggccttctcattttttccatggaaatgacaaatgtatctcacccaactgcagtttgtatcaagcccttaatagaatttccagcatacaataaaagccttataaataatattccattgttatgcaatcaacgtcacgaagagattttagttttgtctttattcatgttttcagggtgaacctggtctgcctggatatccaggaaacccaggtatcaaagggtcggtgggagagactggtcttcctggattaccaggaaaccctggagcaaaaggtcaaccgggcctgcctggattcccaggtaggtgttcctttcccctttcctttcttttcccctctaattagtattggaagcaatctcttatttggcagacttgcatcatgtaccggctagcagcataacctcaaggtagaatgttaatgcttctttgcccacatgcctttctgtacagaatgagaaggagagaatgagtattcttgcctcagcagtacaatatcttgtgggcagagacactagtttggtggggcctttactattttttttcaggtgataatgtactctgtcgagctcttgcctgctgctgatagaacattgtccacaggcacacagctggcggctgttggtagaacaattccagtgttcattcagatgacaaggactgagtcattcaagcaaagagacttagcactgtagtgcagtagacagcctgacctagattgctgtatctgttgtttcatgcttccatgtaatttttactttggcttttgaatttcacagtggcacagataggtctttggttctctctctctctctctctctctctcagtctctctctctgggtctctctgtctctctctgtctctctctgtctctttctccctctctctgtctctctctctagtaaactgctgtttctttctctttttctcctttttattcttttttcttagatattttgtttatttacatttcaaatgttaccccctttccctgtttccactctggaaaccccctattccatcctccctccccctgcttctatgagggtgctcacccatccactcctgccttctcaccctggcattcccctacactggggcactgagcattcacaggattaaaggcgtctcctcccattgttgtctgacaagggcatcctctgctacatatgcagctggagccatgggtccctccatatgtactctttggttggtagcttagtccctgggagctctgggggatctggttggttgttattgctgttcttcctatggagttgcaaactccttcaactccttcagtcctttctctaactccttcattggagaccccatgctcagtccaatggatggctgagagcatcaacatctgtatttgtcagattctggcagagcctcctaggagacaactatatcaggctcctgtgagcaagcaaatcacttaatggcatccacattagtgtctgggtttggtgtttgtatatgggatagagccatgctccaacatataataaggacacatgctccacactatgttcatagctgccttatttataatagccagaagctggaaagaacccagatgtccctcaacagaggaatggatacagaaaatgtggtacatttacacaatggagtactacacagctattaaagacagtgaattcatgaaattcttaggcaaatgcatggaactagaaaatatcatcgtaagtgatgtaactcagtcacaaaaaaacacacatggtatgcacttactgataagtggatattagcctaaaagcctggaatactcaagatataattcacagaccacatgaagctcaagaagagggaagaccaaaatgtgggtgttttggtccttcttaaaagggggaacaaactacccgtgggagcaaatacaaatatgtagaggtccatacaaagtatggagcagagaattaaagaaagaccatccagagactgccccactcggttatttttctcctaaccttttaatggaagtataacatatacagagaaaagtacacaaatattcctgtctataaataagtttatgcctgttatttgctaactctaaaatgggtcttttagaggccatgcggttttttcaagatgtttacattttttatgaactctcaaaatgtaatgctttctatcaaatattaaagacttgctgttttacaaaccataaataaaaagtgctaatatatcaaataattgcttaaaactgagccaccaatactgtatatgactgatacatttatcaggagatgtgaattcagtgatccaaggtagaaagactatatatatgcttcaactccttttgtgtttattttccccccctgaaggttgtaaattatctcattttcaaaatacactgatctttcttttagtacattgtactgtggcttggaatctgttcaatgcatctactccaaattctcatcaagaaactgttgacaccagaagcatcatgcatacatagaagccacacttcttaagcctcctcaagtagtaccactaactggggatcatgcactaagactcccaagccttcaggggagattcatattcaaatcagtactctagttattcattgggctttactaattgtagaaaattaactcatacataactcattcagtttttttctcttctgttggtttttaacccctttatactcttttagtgactgtcctagacatttcaatactctttatgttctcatacaatagcaacattataccatttcatataaaatataaagtaaatgtaaacagtgtaattctattctttatgaaagtctttctgactgtctccatgcatttcatttttatgtacatgatgaatcttacaattaattgctattatcattttatattgctggtgtcaggacacaagaccttatgcttgctaggcacgtgctctacaactgacttgcgtctctagctttatatgtgttttaagctctatctagagtttattgaaccctcaagaatttattataggaaggggaatacatttttccacgtacctatctattttccatttgaattgttctacattttttttacagcacagttacacttgctattattccctagagcctgatctactttcactgtcatttattatgaagtgcctactggtgtcaaaagatctcatatttacctaaacatgtctttatttcaccatcggtgtaagaaaaatttagccctgtgggtattgggcctttagagtttgaattgtgggtcttttgcatgctaaggcagcactgtccactgaaccacattcctagcagcaagtctatctttgacatttgttccctcactgagtatttttccactatcttttatctaaatattgtcctaataataaatccatattttaaaataattatttcctgtatattatacactgaggttttttctggatgcattttctgtagcatttttaaaggtgtgtgtgtgtgtgtgtgtgtgtgtgtgtgtgtgtgtgtatgtgtgtaggatatgagatcatccatgaagatacacaggatatggcatcagatctctagttataggtagttgtaaggttgggagtctctgtacttaatgggcataataggaactaaattctggtccttggaagaatgttgtgctaagttaaatactgagctctctctccagctagtaccattgatttgttccattctcctgtgacgagctgtcattatatttatttatttatttatttattatttactgatattcctgcatctataaaattgttactttagaagaattttaggaagatccatctatttcctcttcatctagttatttcagatttttcccatttatagtaataataggttattcaatattgtctcatttgttttggaggttttggcttgcttgcttccttccttccttccttccttccttccttccttccttccttcctttctttctttctttctttctttctttctttctttctttctttcattctttcgtgtttgtctgtgtgtctgtgtgtatctgtgtgtgtctgtgtgtgtctgtgtacgtacatgcagatatcaagggaaaaccagaggtcatttgttctgttccttcaccatgtggggtttgaggctcaaacttgggttatcaggcttgacggcaacctttttactcagtgaactatctcatcaactttggccatatttcctttcaagtttttggttttgtttagattttactttcacagctgttaattatcttcatgtttactgattcggttttttctggtttgttctttatgctgttgctatatataagaaaaatagcgggtttttttccttttaagagttacctcacacacacacacacacacacacacacacacacacacacacacaaagagttaccttatttcaccagaaattgaccatttttcactcgtgtgcattttaatctgaagatttttttcttattaatttctggtgctggcaatgaactcagtgtaacacatgtacatacattttctcctgagttttataaccaattcctatgactgtaggttcttggccacattggtaaatcaattttaaagaagttttctacttattttaacattctaataattcaggagtctcattctgctgtttgctcttctatactgtttaagattgatattccttcatatgaggtatcacttgttgtgccttgtctagacttttatatttctgtgataaaatgtcatgagcaagacaacttttttaaaacaattttttattagatatttccttcacttacatttcaaatgctatcccaaaagtcccctataccctccctccgccctgcaccccaacccacccactcctgtttcctggccttggcattcccctgtactggggcatataatctttgcaagaccaaggacaacttttaatagtgtctgagagttgaagagggttacagttcataaccatcatagttgagaacatggtagcaggcaagcatcagtagctgagagctcacctcttgagacagttatgatgcacagagagctaacttggatggatgtggagttttaaatctcaaagccccccactcccagtgacacatctcctacaacaaggccacattagaagtaatcattcaaaaatacttccatcaactagaggttatgttcattcgaaccaccacatgcactgaatgttataaacggtacacatagggattccagattctgtcaaatttctttataaaaacgttgactattctatcaggtcatccattttttgaaaatcaacttgatcttacattgattgaatttaggctttattacaatggagaatttccattgcccttacccttaactgtacctcctaggacctggtatatgagctttccttttaatctgtggattttctggagttatttccgttgaaattttttaggtaatgttttcattcattaaagtatattgtcagtaaaacttcttagctgtctttcattagaagatttttattgttccttaattcaattttatcaattatttctaagatgccttcccccatgaacatttgcagttccttgttaaatcaaagactaatcgtggtactgatgtgggatgactttgcaaattgacaactctcaaactaattcattttaatatataaaaatattttctgtatgtctcacatagtaataatgtaaggtctttagatttattttttcatgtatgtgatttttttgcctgcatatatttatatgaactaaatatgttacttgtacctgtttaagttaggcaaggtcatcagatactctgaaactggagttatgggttggctgtgagccaacttgtgaaggcaagaaatccaacccagctcctctacaagagcaacaactgctctcaactgctaagtcatctctctaacnnnnnnnnnnnnnnnnnnnnnnnnnnnnnnnnnnnactttcgacaaaaagcctccaaagcaaataggaacttcttgaagttatataatcacaagacaccaaatatggctgataatttgagtaggcttgaactttatcctttttcaaagtttcaaactaagaacctaaccacacagctaccttagtttgtttaaatgaatcactaaacagaagacgtgcctgagctgcgcctgtactagtgcctattgagatggagtaatgattgatgacactgttgtggtataatctcttgcaaaacaatagaaaatgaatacactgctcttctagctatacttcaatttcttctccactccaaatacgtctagtgttcactttcatatggttatatatctttctgtaagaaaatttaaacacctaaacaaatgaaaacaattatatctatacatattataatacagatagcatattcatggaataaatttttttaatttgagttgtcgaaagaatggcccatcaattcaaagtaattccagttcataagtcaaacaattaaaaaaaataggaactagagagttctctcagggattaagagcagtgattactcttgcagcagacccaggtcaatacttagcacctcatattggctcataaccatctgttactccagttccaggccatttgacaaccttttctgaatttctagggcaagagacactcatatggtaatatatatataaaacattcacatacataaaataagtcaaaaaagagaaagaaaaaatttaaaaactaatgctaaaatggaaagggtgttgaatatgccaaatagtattgaaaaagaaaaaaaccttcattgaaaaagctttgttggtaggcttgcactccatgatctccaggtgtgtagtaattaaggtggtattatacttacataaagattagtaagtaagagagcatagaaaaagacccatgttatacaataaagtgacctgaataaagtttctttacaaaatggaaaataaaggctatacaatgaaggttgcttggtgttttggctgtgactgatccttaaatggctgaactatctctctggccatcactgaagctttcttaaaatacaaaacacaacaacttcaaaagaaaataattgaaagatttcatttaagcaaaatttaaaactctgattatcaaagcaagttattataaaaataaataggaaaagtaaagtttaaaatcaattgacatatgggacagattggtatctgacaaatataaataacttctataactcagtaagaagaaatacaattcaatttttagaaatgagaaaaattttgaactgatatttcacaaaagaatatatgctgatggctggtcagtacatgagaaggtgaccaatgccattaaccatggaagtaaacacattaaaatcacatgactaacactgtggctgttttttttcctagttttttttttaattaatcattccattcatttacatctcaaatgatatcccacttcccggttatccctccacaaatccccatcccttctgccctctccccccttccttttgactctatgagggtgctccctcacccacccactcaccctacccgcctcagtgctccatcatccacctacgctgggacatcaaacctccacaggaccaaggacctccactcccattgatgtcacacaggccatccatcctctgctacatatgtatctggagccatggattcctccatgtgtactccttggttggtggtttattccctgggagctctgggtggtccagccagctgacagtgtccttcctatgggattgcaattctactctgctcctccagtctttcctccagctcccccactggggtccctgagctcagtctgatggttggccgcaagcatccgcatctacattggtcaggtgctggccgagccttccaaggaactgttgaatttttcgaagcaacagttttatatgttgatattacaacatatattgtgcatagatctggaacaactggctgttttaaatctaaaataacttctatattttaataaaacataaaacaaatcttagtctgacctagaaattccattcttggccatttactcaagataaaggcatatattttcacaaaaataaaagaagtcatgcaaaatgtccatagccactttattcattatacctaaaaaaacctggcaacaaaatcatgtccaacaacggatactgaatttaaaaccaagtattaaatctaatactaaaaattttattaccagtacagtatcactgaaattatttttatatttatggatacataatgatatctactcccgtcaaattaatttgaaattatctagcaatcatcaacatgttttggattcacttttggtccttattatttcaatgctaattctctaaatttaagcttcatttataactcataaaggaatgtactttttttaattattttttttgagtgttcagaagcattttatttattttttttaattaggtattttcctcatttacattttcaatgctatcccaaaagtcccccatacccacccccccaatcccctacccacccactccccctttttggccctggcgttcccctgtactggggcatataaagtttttttaattcttaaactgaggtttttttattctaggaacaccaggacttcctggaccaaaaggtatgaatggtcctcctggtaaccctggctttcccggagaacctggtcctgtaggtaagtaagaaagacagcattgctgttctgtaagactaaagcttttcatagtcaaatctgctcctgctgtgaagaagaaacagggtgctcattcacttatcacttcatatcggacatgaactgaataaatttcattttaaaattatcaaaatttatctctagcaggtattgttgtcccagctcacattttctagggagagtaattctctctatgaaggtcacgttgtagcaatatctttgtttattgacttttaaaataattcccgtcttggcccttacctgaaaagcacctcatccctccttaacacctttcctctcgattatcgtgaagttagactaaaatgagttattgttatttttgctcatcattaccttgctttactctttgttctataagatttcataatttagaggagcatttcagaaggatttgttactttggggtttgaaattttggtttgtttttaattatggggggtaggtattgtgcatggaggtgacatgtgccagtctgcgggaactggaattacaggggtttatgaacgacctgatgcagacgctgggaacagaactcagatccggtggaagaactgcaagtgttcttgacaactgagccatctccagcccacgttgttactgttaggattatttggtgctttaataggaagactggagaaggatgtggaaggaagctgaaaggatcagtgtaacctgtagtgttgttctttaggtgccggagggcgtcctggaccaccaggacctcctggtgaaaaaggcaagccaggtcaagatggcattcctgggccagcaggacaaaagggagaaccaggtactatagtttttgtatgtttgtttgtttcatttttttgaattttctaattacctcacggccttctttacagctacaataaaactctgtcttccttacaatcttctaaggtcccacacagttcccccttcctaattaacttcttccttggcatcctgaaaataacagctcatttttgttgaacaagttgcttttgtctgaagaaaaaagttatttatattgtccacttccttttacaagtactgacctaggcattttcaagtgtttcgttcattgtccaacctgtactttacttatgcattttcatccaagtgtacaaagtatctccaagggtcatcacatgtacagtgtgtgtgcatgtgtgcgtgcgttgcttcttttcaaaatgactgcagattgactaaaggttatcagtcttgctggaaagcacatttactcactgagccatccttccagctatgtagcttcctttctagaataactgacaaatatcaagtagattgtgacaacataaagaattatcctataccagtctcgaaaagagtttgttttcttatatgcaccatgagctttccagagccagaagaaggtgtcagatcccctggaaatggagttatagaagtctttgaagtatcatgtgggattagggagctaaacttacttcctctgcaagagcagctgagctgaaactctggtccctatagttttcttatgttgaaactattctatgttagaagtcaatcttctggggaagagcattaacttagtggtaatgcgtgtttctagaatgtgcaagccctaggtctgtccaagaaaagaagagttggggaggacagaagaaaannnnnnnnnnnnnnnnnnnnnnnnnnnnnnnnnnnnnnnnnnnnnnnnnnnnnnnnnnnnnnnnnnnnnnnnnnnnnnnnagttaaaataaaaatattcttcagtccatttatttttctacctctaccatttactattataaaatacatctgaaatttttagaaaacagctcaacctatttttagggtacttcttattcctagcaaatagcctatgttactaagaaagtcatccttacagagacttcaataaatagcctttcattcaaatcataaatactgaggacatgacgcagaaaagaggcgaaaattgcaggaaatttagaagctttcatttgtccagaaaaccactcttctcttctgccagagtagtatcataggaacatatgaggcacttctgtagaaacacatgccaagagtaagaatttttcttgaaaactcatctaagagctacacataatgacatacacctgaggctgaagcaggtagattatgaattctgtgccaacctgggcctgggctatccaaagttctcaggtgagaggaggccattatgtgtgaatacatatctatcttccctctttagtatgtgatcttaaaataagtcctaaactctctctctctttttttttttttgttttttttttttgttttttttttttgtttttgtttttttgagacagggtttctctgtgtagccctggctgtcctggaactcactttgtaaaccaggcaggccttgaactcagaaatccgcctgcctctgcctcccaagtgctgggattaaaggcatgtgccaccatgcccggctaagtcctaaactcttaacacaaatctgaataactacagatatgcatgttgataccttgaaatgatcattagcagttctatagaagttttctcaaactaaaaatctatctcctaaaatttccagtatgcttttcatgaaagtttaatataccactgtcttacggtttgtaagtattagtatttcataataaaatgtcaagagcagtttgtctagattatgattatgaacttttaatatcatggtctgaatataatagcagccattgaatctcattagtcttaaaattagatccaaagctgtgatagttgtcttcatccatcttgaaccaattcttgaagatatttttatacattttatatctggtctatcttttttcctcataacttccggtcatgttataattgccctctgttctaatatgaaggatgccggcattagtttttcattgctaataattgcttctgatgacagatacatgtgtttaataaagagaaaagattttgcatgtgtttgaagcaaatttaccctagtgaatttcattagcttatcatgtagctttaggcttataggtgagcttatgattcagcattcagtatgactgcatgtatccctaattacacttttacttctacaggacaaaagggtgatggaggatcacctggacttccaggaaatcctggccttccaggttcaaagggtgagccaggctttcagggattccctggtatgccaggtcccccaggtcctcctggttctcctggtcaagctttggaaggtcccaaaggaaaccctgggcctcaaggccctcctgggagaccaggtatgatcgtgtgtggtatgaaaaatgccctgtttaccagttcagttagttgattttgctggcaggttattcagtcttcaagattttagaatttgtcatgtgagaacttcttttaagaaaatagctaggttcatacctagcttgttgcaatatatacattcatttcaataatgcatgtattatttacctaaagttcatcttgaatggaaaaaagagaaaatggtaaggttttgttagtattgttattaaagataacctggcatcaaaatgcaacctgcaccttttttaatgtctgcttcttagcatgtcatcacagaaatcattctagtgatcaccaagtacatgcttgtgttccatatcagaagctgttgctatggttccgtcacatgatcagcaaatgtcaccaggcacaataaaaacttaatctctaggaactaggcaatcacatttatcttcagcagcacagcatggtcaaattgactcataatctcttcatacctcatgtctgtccctctctttcctgtgctcactctttagtagatcaattttgcatccaagggccagattctcatttttgtgtctctgctgcgtcattccattctattaattgggaaatgctcattctaaccccaggttaatgttgctgagctcaatagctcaatcactgttgatagcctattaaaacatttgaggtacttactattcattttgggcgggtaactgaaaattttgcctttattattttttaaagaagagaaatttgagatagaaagaaacaaaacaattgtcttttcattgctcaaatattcttaattcatttctaaagtatatcataaaactaaaagttatatttatattgcaagaattgaacttgattttactaatatgtgccctaaaacatgaattaagcagtataatgtactgaattcgggacatcattttcaaagtcagctgtaatgtgatctgacttgattgtttctgaagagagttgctttttcctttgtttaccactgaagaaagacagaggaaatattctcagccacattaactgtcttgcatgcaatataaagaactgaagccagtgtcttgctttgtttgcctgtcataattcaaataaaccaaactattatccccttatattctaattagcgctgcacttatttgtaactaggagtggagctctcagttgaacatttctgtaataatagtaatagaaaagcagtagccacaaacatgattttgcaatcactgtttctaaagactaatcaaccttctccaaagaagaatgcacatctaatgaatgtttgatttcttgatttgtttataaactacagatctaaaataaagtgttaaatcaatttctcttagaattaaatgttccaaatttgagctcataacaatgaacatcataatatgatttttttgaactttcaaactttattacgtgtagttttccttttaacattaatgcttaatagagatagtttggtttatataagatgcatgaatatgaactttcagagagttctattattaaattcaactttaacttgagagtatttagtataatgctatagtttcttgatgtttctaacagttttgatattttcctttttgttaatgatgacattgggctttggtgaacttccatccctacccaggtcctccaggttagctccttaactccaaagtagtaattgcatgaaatttgaaactttatcaatgtatttatgtacttatatacgtgtatatacacatatgtgcctgcttatatatgtatgtgtgtaatgccttcaaggttctaaatatattttaagagcatatgccaattcagttttgaaatggtggcctgggcctaagttgtcagaatattgtagcgccaagtatttcccttggaatggttccaaattatccaatcatggagatggactaaattaaatacttcaaaattcatacttctgtgtcatttttaattgagattttatagtactcaattttgtcaaagtatgcttttcctttgttagaaagtattttattgcattataaacttttaatgcaataaaattaaactcattcagaaaagcatctttaataataataataataataataataatgtaggtaatgaaatccttgatttgatacacacacacacacacacacacacacacacacacaaacacacctctataaggttttcaaacagcttcatattttggcttgtcacatattttcaaaggtttacacattttttaacttctgagcatatttgtgtgtatatatatgggctgcaggtgcccactaatatcagaggcataagactcacctggagttctttgtatatattgaataatagccctctatcagatttaggattggtaaatatcttttcccaatctcttggttgcctttttgtcatattgacagagtcctttgctttacagtgtcctttgtcctttgcagttttatgaggtcccacttgttgattcttgatctttcagcacaaaccattgctgttctgttcaggaatctttcccttgtgcccatattttcaaggctcttccccactttctcctctataagtttcagtggctctggttttatgtggagatccttgatccacttgaacttgagctttgtacatggagataagaatggatcaactttcattcttctacatgctgaccgccattgaaccaggaacatttgttgaaaatgctgtctgttttccactggatggctttagctcctttgtcaaagatcaagtgaccatatgtgtgtgggttcatttctgcgtcttcgattctattccattgatctacctgcccttgactataccaataccatgaagtttttatcacaattgttccgcagtacagcttgaggtaagggatggatctggagaatatcattttgagtgatgtaacccaatcacaaaagaacacacatgatatacactcactgataagtggatattagcccagaaacttaaaatacccaagatacaatttgcaaaacacatgaaactcaagaaggaagaccaaaatgtggatattttgactctttttagtaggtggaacaaaatacccatggaaggagttacagagacaaagttcggaacagaggctgaagaaataaccatccagagacagctccacctggggatccatcccatatacaatcaccaaacccagacactgttgaggatgccaacaagtgtttgctaacaggagcctgatatagctgtctcttgagagggctctgccagtgcctggcaaatacagaagtggatgctcacagtcatccattggactgagctcagggtccacaatgaaggagctagagaaagtacccaaggagctgaaagcatttacagccccataggaggaacaacaatatgaactaaccagtacccccagagctctcttggactaaaccaccaaccaaagaatacacatgatgggactcatggctccaactgtatatgaggcagaggataacctagttggtcatcaatgggagcagaggcccttgggtctgtgaaggccctttaccccagtgtagggggatgacagggccaggaagtgagagtggtgggttgttgcacaggtggaggggggaggggataggtggttttaggaggggaaaccaggaaagggataagatatgaaatgataaagaaaatatctaataaaaaaataagactcacctggagctgaagtcacaaacagttgtgagctgtctaaaatgggtactgagaactgaacttgggccctttgcaagagcaatgtctacttttaaccactgagacatctatccaggtcctttgacacataatttttaaattgctttgctgtgaagaactaataagcataaaggaaaatataacttaatgtaaccagcacagattaaaggctcacaatcacatatatggtcatcacacgtagcaagaaattatgccaaagaaaaattatcaagagttacttcacagggttggaaaaaaaaagatctgttgcttctagttttcttttttctttttttttaaatgtgtacccaatctggtataaaaagttaaccatggacatctcaatatatttattattttcaagataaatagtccttttctcttttgtagaaaggaagtaaaataggtcaaaatataatcctgagatatgacttttgaaaatggggagggtttttttttaattggatttttttatatacatttcaaatgttataccttttcccggtcccctctcccccctaaatcccctatcccacccccctccctctgcttctatgaacccacccacccacttctgcctccctgtactggggcatagagctttcacaggaccaagggcctctcttcctattgatttcggacaaggccatcctctgctacatatgcagttggagccatgtgtccctccatgtataatctttggttggtggtttagttcctgggagctctggggggtctggttggttgannnnnnnnnnnnnnnnnnnnttggttgatattgttgttcctcctgtggggctacaaaccccttcagctccttcagtcctttaagtcctccattggggaccctgtgctcagtccaatggtcagctgcaagcatcttctgtatttgtcaggctctggcagagcctatattcaccacagtttgtagagggagggagatatgattctctatgtcaattgattccttgatttatttctaccataccaacccatgcacacgtacattcatacatgcatacacatatgtgcaaaatgttttatgtgtaagatctattgattaggaaaattttaaagatgcaagctctgaagacaaattttatcatgacaactgtaatagagaagaccccattataacaaagaaaaggaactaaactcagctccaaataaaacagaaacaaagacttccagggacataaggagagagttattgactgaaacttactaagaagtactagaaagcaagaggagtcttacacttacttcatatgattctcactgaaggcaggccaaggatttagacatcagagtgaggaatgaggaacttgatcagatgttaactactggagatttagagtttgaaaggtactaaactgatttggttggatttttcctgtaactgggcttcaaatgctaaaaaaaaaaaaaaaaaaaaaaaaaaaaaaaaaagaggaagggggataatgtggatgttaggtgagatgtagcaagaagtctcagggattctggtttaaggtttagtcagagaaagaattatttttcacacaggaaaactaagacccaaaattattgagaatgtggacttcccagtactcttctactagtagcaccctataattcttgcacaaactgttgatgtttatgatatggtttcttgataaattcatggagcaaaactgcttttatcatgttaggaaccttatagttagctagatcttagatctagttatctcctcctcttcctcctcctctttttcctcctcttcctcctcttcctactcctcccttcctcctcctcctactcttctttctcctcttcctttcttctcctcctaccccttctccttcttctccttcttctgttatctcacatctccgtcaatccctaataacatcatcttacattcttcctaagcggatgctcttgagtatattaagacagtgaaaatgatttaactatcaacaggataaagacaagattggggtaactttgaagcaattttcactgttattctgtctaacttgcctagaattcttctgccctgatcactgctagactggaatgcaagctaggattttttttcctgctatactagaatatatttgaagaagaaagagaaaagtatctccaatacttttttttttggtttttcgagacagggtttctctgtgtagccctggctgtcctggaactcactttgtagaccaggctggcctcgaactcagaaatctgcctgtctctgcctcctgagtgctgggattaaaggcgtgtgccaccacgcccggctttccccaatactttttaaaccaatttaacaacttcccctttgttaaacatgataaaaattgtaattattgaaagctagcctctgtgatggttacaataggagaagaaagcaactttgagtggaaattagaattaaaatataacagctgattctataacctacctaccttcagtttctttttcagttaaatttaagtacatgatttgaaaaataataaattgaggcctcacacataaaaattgacttggcatatagctcattaatatgtagccctttagaaattaaactcttagaaattttgctatgatatggtccaaagtttcctgtgctgatgaatcattaaaatacctcatatcaataaaatatctttctgaatattattattgagtcattctaaagctaatattcatataacgtatcttcactttgaactatgctaaaagcaattctaagctagttaattgagtgtccagactataagtctttggctaatttgttgtatgtggtttggagactatttacataaactgaaatatattattctaagtttccaattctcaaatgctcctaaatttttggttttaatcatcattgtgttcttttagcatcttacacatagcagacagtagttctatatttcgaaacttgactttgatccttatgtaaacatgcaaggaaggacagtatagataacactattacattcagagagattgaattacccacagtcatatagttacaaagaagcaaggtcaagaggaagttccaaggtcttttaactcgtggtactcaatggtcttgcactatttattctctttaaaattcaatgtttataaatcatagcaagaactctaagaaaagagaaattgtgtttagagttgatactaaccaaagaatgttctacttgtagactttaatattgttacataatttttcttctttaaatggttaatagtctgataatacatgcattgaataatactttaaaaaaaagttgttgtaatacttaaaatggcttggggtaggttgctgcatgccacaatatttttaaagtacccctttactaatagtcttcatatcattggaaaattggaatatttatttttaaattcaatggctgtttatgcttagtacttaaaacaaatactaatagaagatggcctcctgatttattatgaaaaattaaaatatgactttataaaaggtatttgaatagggcaaacaaaagcaaaagtcataatggttgtgccatagtttaagttttctctgagtttcaggtcagcttcctaattatatttttgcctgtgaggtttgaaaagttaactgttcctatcatattggttcactccgaacatcaaaatacatttttacttcatgtttgtatcaaagcatggcagaggtttaaatacttgttcacagttactttgttaaagaaaatgaaggcttttggtgaaatggtactatcttgccaactttaatgttttgaattgctaatatttagaaatatccagtagtcacgttaacatagtctcttaaatagatcttccctcccattaatggccaacagcttattatctagaataagcactattttaaacatatttagttctctatatttctggatgggtctgtttgcctattgattgtgctgtaggtataagaaatgcttacaaagagaattactgttcaacttgctctataatgtgaaccacttctaactcatcatctgattttgtactgtgtgatgtctgatcctgctgatatcgatcttttggctttggtgaactctgatcttcccaggttttcaaggttagactcttcgctggtcacttttctcctttattaaatgctttatatatgtgataagagagatgcactttattattataattcataagttattgaaaatgatgttatcctcaaatactaccctattgggttttgacatttttgacttattgatatttgatataatatcagttttttgtggtctgattgtttgtaatagatacttttatatataaatacctggtaaaactgaaatagccatacaaacgcctttacattataaactgcattaagatatttaattaagcaaacatctggataatttctaatctctgcatatagatttttttttgaaatttttacacacaattgccttaagctgtgcgatcaatgctgttttcaataatagagaaagaatgctattagatacagttaaaataaaactctgtttttactagaatcctaatttaatttttttgagacagtcaaaatatcatgtctgagatgacataaaattcccagtattttctttttagttgataatagaaactccaaatggagaataatgacatgcaaaggttcaatttccctatcttatatcttccctcatcattgtcattgggttggttcaaagactattcagttttagcttaacagcctaaattgctaccagacttctagcctaaattgtacaaattactgagtttatttagaaaatcttattctagtgtatttgagctaagcagctgtggtttatgtttttccaagtacaaagtaactccaaacctttcattacaattgcaaaaggatttttttgtgattgtgatatctgtttgacaagctaaggtgattgtatgatttaagttgtcaaaattaattgctgtattatcacgaacttgctctttgtcataaccagataattaccacattgtgaaaccacttaaaaattctttaaacattaaaaatatcataagatacattttatgtttaattttattactaataattaatagtaagcataactatcaaaacaccaacatttcatggttgttagtatttggtaggcactgtccagtgccaaagccacctggttgcttaagggaactgatatctttatttagaatgatatgttaaaaatgtagtacaaaattttaaaaaacccatggaaatattttgaaatgaattttatatatactatactgaaacaataaatatatggcatttaaaagatatcccatgtgccaaacatatcaataaaatgaacttaaagttagtgtgcttaactattttaaaactattttaactgctcgataagccggtgctcagatgttagatgtttgcctaacatacataaagccatatgcgtgactcacacaatacaaaaattgcacagtggtaaaaggtaaataaacatatcttcttataaataaagcagttgaagttttttgttttacggaaatccatctaacctaggacttagtcaaatgctatgctcatccctaagtaatttaatgtttatctcagtaagaggaatggcttgaattcctgattgctctacaacagtcattccctaagtgttggtcatgtggccagcagcactaagtactaggggacatatggagccaatacttcaggatgtgacccaggaaactgttttgatatctccctttccacaggagcatactgtaatttgagactaatgctatcctatgtctcatttcaatttgagtcaaacacgcgtacatggattacagaagcaaacatcatatccagagttgttttagatctgagtttactatgtttattagaaaataaaatacaaaggtctggggagatgttgctgagttggtagactatttggctgatatgcatgaatccccgggatggcataagctagatgttgtggtacatccctgtaatcctagcacttgggtcttagggcaggcagaccataagttcaaggtcatttttggtgcaataatgagttcaacaataacctgagatacaggaggcactgttccagaaacgaatgtaaacctaaggggtctaaaaatcagcattaatgacaaaaatgtctacatttactcagtcttcaccacaaagtaacaaaagatgactgatattttaaaaacctggaatactatactaatatgtggtcatttgttgtgcattaccaaggtccaccaggtacagaaggtcctcgtggaccccctggaaatggaggtatcaaaggagagaggggaaatccaggcccacctgggcagccaggcttacctggtttgaaaggagatcaaggaccaccaggactcccggtaagaagtgagactagatatttgatggtagaatagtgtgggtgacagttttcaaaatgggaattctgagcagcagaattttattaacactcaccacatagctcactggtgaagtaaaaagaaaatagaaggcaaggctcctagtcttcccatgaaattgtctttactgttttatactaaaagagttttggtgagagcaaacctatgaaaagaaaacttacatatacacatcagtacattgtattttagatgaatacacccataggaaagtaattatggcaagtaggaatagtttagactttggaattagagtcagggtcaggtttcagttgcactatttttctcagtttatgcttctctcttctataaccacagtgcagttatcaactttgcaaaatttaagagaaatcaactattttaatttctactctttctgttctgattttatcaattggtatagtaatgtaaattttagcactacactctgtaacaaggtatccagaccaaattgtgtgttccatttaactgctatgtctctttattctataatatggaatcgttccttagccttttttctttcatgattttaatacttaaaaagtgtagcctattctcactttaaaaatgtagcagaagatggccttatctggcatcactgggagggaaaccccttggtcctttggagatttgataacccagtgtaggagaatggtaggctgctgacagaggagtggatgtggggtgggggggggagagggaagaggggatgggggcttgtagatggggaactgagaagggggataacatttgatatgtaaaaaaataaccagtaaaataatagaataagccttcttttgtctaatttgtcattttaattaaattcaggttgtacatcattagctagaatattccaagagcaatgaaaatactgtccttatcaaaatttatccataaatttagcatctattaatgagttttgaatggataatttctactgggttaatggcaaaatggtgactttgtaaacttggcattatatccacatgtaccatttagttctactgtaggcaagagatgtcccttctattctacgcagtcacatatttattatggacatgggttcatgtttttttttccagtcatttataaaatttgaagctgtcattgcttattttgatattctcattgttccagatttgatagccatatcgagctggatccgatgacattgtgacatgcttctaaaactgctttttctttgacactttcttatattttgacataaaaatacattctcacattaggcctttttcagtcctattaaaagcttcacagctctacagttagtgtagtacagtagcctcttcaatcatcttgacattatatgttcttccttttagattcttaagctattttctctctcttcctccccccttcgttctcattttttgttgctttctatattatcagtggctctcatcaacctaattatcatcccaagattatatttgccaagtctttcagactttatcatttctccatctaccactccagatctagagtacaaagaaagtgctttttaataaccattacttactaaatactctatatcatcaaatttctaaacatgtaacaagaactttgtcatttgatccttcccaccactccataaagtaggcatacttttttctccatgatgcagaagagaaactatgggtaaaaggttaaatattttaaagtcacaggtatttggaaggctctatgccccagtgtaggggaatcccagggccaggaagcaggagggggtgggttggtgagcaggggagaggggatagggggtttttggaggggaaaccagggaaggggataacatttgaaatgtaaataaagaatatatctttttaaaaaatcacaggtaataagcagagtgagaatttggatccttccagtttaactggaaaaacagctctctaagccactgtgcaataactgaatctttattctactctgtcctagttatgattctgataccaatgacttttatttatttagggtaaccctggccggccaggtcttaatggaatgaaaggagatcctggtctccctggtgttccaggattcccaggtatttgaaagagtggtttaaggttttctttatatttttaagtatttttatttattctttgaacattccatatattcaatatattgttatcgaatgtacctctactaccttcctcaagatcagtgcaattgtctctctcccaacttcatgttctctttattactcctccttctcctctactatactatacactatataatatactactatacttctatagtagtagtagtaatagtagtagtagtagtggtagtagtagtggtagtagtggtagtagtagtagtagtagttgttgttgttgttgttataatactaaacaataccctaagtccaactagtggtgaccctattaagttcctttggaaaaaactggtttttgctttgctttgctttgctttgctttgctttgctttgctctgctttgttttgtttgtcttattttcctacataaggctgtcttgttgcatatttatgccattttattttatatatcatctttccaggaatgaaaggacccattggagtaccaggctccactggccctgatggggaaccaggtcttactgggcccccaggtaagaatttttcttctcctaaggctgtttatgcctgatactttgaaacatgaaagactttttgaagtatccgtttgtctttccaaattatcaacataattttcttaccagcatcatttcctaatttcttaaactctttatttagttctattatattgatagccaccttattaagtttaagttagaagtacctagccccattcaacaggaggaaagctagccagccagaatggagctttcagatcaggcctagctcgattcctatgaattccttaactcaagtctgtggtatcttcagtaatagggccttaccatcaagttttgggtaaccacgagcctgtaatatttggggatgacctatggtaactcactacccagtaactgcaaaagaagtaactcattacctgcactggacttttcatttgttagcctgtggtatctactagaggtattgctattctgataatgagttaccacattttaacttgtatatatgtgtatatgtgtatatggatgtgtatatgtgtgcatgtgtgtgcgtgtgtgaatttctgcaatagtaggtttccatatgatgtgttcaaaggtatttaatgttactatccatcctaattgcccctcctctacactgccttcctttccccaccccaatttaacccttacagtttttagtccagttttctatctctcctcctctgaaatttcctctctctggtcctttattactttcctgacttttatggatattccaaatgaaacaatcatctgatggcttaaagctaacttccacagattagagaaaacatggcatttatttttctggtatgggttacctattcagaatgattgtttctaggaccattcatttatgtgcacatttcatgctctttttcttaatatttgaataatataaatatactatattttaaataccctttcatcagttgatcaaaatctctagtctgttttcttttcctggctattgtaatgagaacagcaataaacatcaatgaggagatatctcttttgggattactcaagagtaatacaactggatcacatgtagatctgtttctagctttctgaatcacctccactaattttcaaattggctgcacaaggatgtactcctaccagcagcaaacaagtgttcctttttttccaacacctatgccagcatttgtcattttttttgtttttgtttgtttgtgtatgttatatgtatatatatatatatataaataaataaaatatagacattctgattgggtaagataaagtctcaaagtattttaatttgcatttccctgatatctaaatatgttaaacatttttaaatgattttgcatcctgtgtttagtgtatgtatgtttagcattgctatgtcctggtggaattttttcctttaattagtgtaaaatttccctctttatcttctgattagttttggctttacatttgtttcatcagatattagagtagctacactatgcttgtttttgatccattttcttagaatatctttttccatccttttaccctaaaatgctatctatcattggtcattaggtatgtttctcagcagcaacaacaaaaaagagacagatcatgttttctgatccagtctgttaatctgtgtcactttattggagagctgagaacattaaaagtaattgttgaacaacatgcactgatttctgatattttgttgtcttgtgatgttttattaggcttcttttcatccaatattctgaaaattttaaatctgttcgttgtgcgtgaggatctttacccttctctactgacctaagtattactggaagtactctctgtaaagctagcttatggatcttaaatgctttaaatatatatttatcctataacgttttcctttgtcctattatgactgataatttgggtggatatagtagcctgggatggtgttttgggcttttaacaacttgaataacatcattccaattcattctacctttcatagtttccactgaaaaatcaactgttattgtgactttcttttaccattgaaagatttaatatcctttctttattctgtccatttttaaaattttgtatggggaatttatttcctggcccagactatggtgctttgtatacctcttagaccttgatttctttccttatattagggacattttattctatgattctggcgaaaatattttctgtaccttttatgtgagctttttctccctctatacctattcttcctagatttggtcttttatagtggcccaaagttcctgtatcttccattattggaattttttaaatttgacattttctttgactgagtgatccaattcttctacctattcttttagacataatatttttctcttccacttggtctaatctaatggtaaggctttcatctaatttttggtttgcatttctgaatatttcatttcaagattttttattttgacatttttgtcagaagttctatttctttattaaatactattttttatatcttgaattgttttgattatttaatcctgtttttgagtgcttcattctagaattcattcttacctcttcaagttccttgataattctcatttttactattttgaaataccttgttacatatcttgagtcacttttctcagggaacattatgacaggagtattaatattttgtgaagactttttgtttagattattcatgtttgtgtatctgtgatgggatcttgaaataggttgttgtcttttctttgttgaatggatatttgaagctctgattcctagaacccaaagttatcatgcaacagaccagatgaataggacttcctgtttagtctttgtgcactttagtgttgatgtcatgtggtgtttcagaagtagtctcagctaaagcacaagctaagcgaattttctaagcacccaaataagccttctgtaaagttaggaaatcctacagcagatcttcaggagtgttgagggaaggttctcaggactgatcctcaagcagtagatgctagtagaattgataatgcaagcctaggatacctacctgaaggagaggagcagggtaggggaatgggaaacagggaatgagggtgcgtataatgctaattcttggagagtgacagtctttatttagggcatggaaaagggtggacttggtaactagcatctttgattctgcattgacaagcggccagtggtacatggcagctatagatggagttggcagctataatctaggcttttttttttttttttgagaggaggggagcaagggttttcagcatagaaggatggagttagctggatgagtctggcgtttctatccagatgagggattactgaaggtgggtcaaaaggctggaatgggctggttttaattttcttaatgaaatgattacaatttccatgaatacacttctgtttaatgtggtagcagttaagtacattcacttgttttttttcaatttatttatttatgtcatgcaaatgcatcttctgatcttaggacaatttggcatctgtttctccagacatttcctcttcaccatctttacttttatgtgttttgcttcttaggtcctcctgggttgcctggtccttcaggacagagtattgtaatcaaaggagatcctggacctccagggattcctggacaacctggattaaaaggtctaccaggacttccaggccctcaaggcctaccaggtacctttgtaggtcattttttatggcccatctatttgagaacattcccttgattcactttttacatgcaaatagtttgtctctcataagaatcccagcaaggaaaagaagaaggggctaccacagaccccacttctctttttcttaaaaatgttaaaataatttaggcccaactggatttcttttaactcctttgggcaagctaatttaaatggcttggtggtatgaaaatctatttctttccttgtaggtccaattggccctccaggagatccaggacgcaatggactcccaggctttgatggtgcaggagggcgcaaaggagacccagggctgccaggacagccaggtaaaatgactaaaacagtgatgttggtcatggtatttatgcgttcaaggcctttggatatggggctctacttggagctgacaactaattacctatggagagagcatgaatagctgtcaaatccagagctggggaaaaataggaaggtacatccaaagaaatatgctataccacgacaagcataaatattttacattttcttttatataatgcattagaaatccaagacattcttccccatattcaagataatcacttttcaactattttgttttattttattttattttagtaaggttagacctagggttttagtgtgggggacaggcaactattgagatgcttcctctgctccattcaatgaatttcagtctgtatattcaaattcattaactaccttagaacattttttcatctttcttcattttgtgatattatagaagataatttccccaatagaatgtagtacatatagatgaaaagtttaaatgatcaccatagaactttgaagattgtagtaaaatcttatgcagagaaaatatattgatatacagatttttaaagtcagtcattaccgtattctttttataatattaacttttgtttctgctaaatgtatttcgtcctgttggttttttttttaactcagtctgttatgatataaccatagttggcccagtctttacagtgtagcctgcgctggcccccaaatcatgacaatcctcttttttcagcctcctaagtactgagaatcagtttcttagatttctatcacaagacaacgtaatcacaaaatgaatttgcttaaacttatttttaaaaaccactaatatgattgctaaaataaaagccaggcagtaatggcacatacctttagtcccagcacttgagaggcagaggcaggcagatctcttgagttcaaagccatcctagtctacagagtgaatttcaggacaaccagtgttatggaaagaatctctgtcttgaaaaaaaaaacaaaaaataaaagattaaaaacataataaattgttaatatgttagtaactatataatatagttatacaaacataaagaatatgtattagaaaaagaggatctttggtgacaaaacagtatagtgatacatatggaccttcttagagacaacactgccaattcagtaacctcgtgtttccagagaatgaacaaattagtgacatctttatcacaggcattggtatgaagtgttctaaaagcaaaaattaccacatacacaatagttaaagccctgggtacaaggagaaccacgtggcacattaaaataatgccttttggatgctggagagatagttcagtggttaagagcactgattgctcctccagaggtactgagttcaattcccaggaaccacatggtggctcacaaccatctgtaatggaatctgatgtcttcttctggtgtgtctgaagatagctacagtgtactcatagacagacaataaatcttttttaaatgatgcattttgaaggcttttaaagaatatgttatgtattttctaagcaagtatcatttagaacaattctccggatgtattaaagaaaaaccttttcaacactgaagctattgaacaaagcagctggtgacattaggtcataagattcaaattcctttagtatatagcaagaaaatagataacatgctggtttcccacaggcaaatcttcttcttacctaaaattctgttcaaaaattttagtgcttaatgtcttcagcctattccaggaggaaagaaatgcatttaaatctctttgagggcaaagaaaataactcatttgtctctctacccattatatctgacaatgcttttatagacaccacataaatattgaacaagttaaccaatcactattctttattaatagccacaatagtggcccagagcttgcttaatcttgtaagccaatgatttcgtacaaataggtgcccgtggattggatggtcccccaggaccagatggattgcaaggacctccaggaccccctggaaccacctctgttgcccatggattcctcatcacacgtcacagtcaaacaacagaagcaccacaatgcccacggggaacagttcatatctatgaaggcttttctctcctgtatgtacaaggaaataaaagagcccatggtcaagacttgggtaagaaaaatgacatctaacttctttccatgccttttgtatttatttcaaaaatcttcttaggttctagagtaaccttggacaaaataaaaatgtacaactctattctatggggactataaattgaagagcatatcagagccaaataacttcagtcactataaattttaaatgaataattttaacttcaaattaaaaacattaaaagcattgcagctagtacgaggtatcttttttcttggtttaaagcaagatgacttcaaagacatgtttccttttccttagtctattagtaataaagcagttgtccagggcaccctatagtatagcagctgcttgattatgcactgtttgtaatttatggatggcagattcttattatgcatccccacatgtcttctctatatttagtcaatggcatgaggctgcactgatgattatcaagacctctcgatccccatgatttctcttcttttcttttcttttcttttcttttcttttcttttcttttctcttctcttctcttctcttctcttctcttctcttctcttctctcctctcctctcctctcctctcctctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccttcccttcccttcccttccctttcttttcttttcttttcttttcttttctttttttccagtttcagcattggttgataagggctaatcattttatctgtggctgtttatattaaaatctaccctccacttcacatccatgaaaacatttaggaagatagtctaggctctcaccttctgggatatctatggttagaagcctcctaacatcttattggctatgaaagtagttctgagcagcagaacttcggaagtgtctgctgcttattctttttgtttgtttgtttgtttgtttttgtttttgttttttcttttttttccattttttattaggtatttagctcatttacatttccaatgctataccaaaagtcccccatacccacccacccccactcccctacccacccacttcccctttttggccctggcattcccctgtactggggcatataaagtttgcgtgtccaatgggcctctctttccagtgatggccgactaggccatcttttgatacatatgcagctcgagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcataagagacagctacatctgggtccttttgataaaaatcttgctagtatatgcaatggtgtcagtgtttggatgctgattatggggtggatccctggatatggcagtctctacatggtccatcctttcatctcagctccaaactttgtctttgtaactccttccatgggtgttttgttcccaattctaaggaggggcatagtgtccacacttcagtcttcattcttcttgagtttcatgtgtttagcaaattttatcttatatcttgggtatcctaggtttggggctaatatccacttatcagtgagtacatattgtgtgagttcctttgtgaatgtgttacctcactcaggatgatgccctccaggtccatccatttggctaggaatttcataaattcattctttttaacagttcgagacagggtttctctgtgtagcacccacatgacagctcacaaccctctataatcccagttccaggggatctagtgccccattctgacctcagtagatactgcatgcacgcagtgcatgcatgcaggcagaatatcattacatgtaaaatagcaaataaaaacaatttaaatatgaaatctaacataacagatactacaaaacattaatttttttatcactgtgacatttttgttttgttttgttttgagacagggtttctctgtgtagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactttctggtataaattggtagaaggactacattatgtttttctaatttttgtgattatattacaattgcatagttctgccttcccttttccccttctaaatttgtctttgtcacacacacacaaacaagcatacacacacatgtatagtgtgtgaatataattaatataatatatatttataaatgtaacatgttcattccatataatgtaccatatatacatgttttcagggctgacctttcggtattagataaccaattggtgtgatcttccctggaggagacaagctgaattttggaatttctgtctgagagggagaaaagaaatattgaaaaacagtaatatgttaagaccttgttatttgggatatgggaagagcgtgatatcatggtttaatttttttgacactgtaatagtgattccatactcttataggtacccaaaaagcacagacttgtttaaacatcatagtcttatcattatgggactttctcttatgcacattttccattgttttatgagaccaggtgtatttacagctgtgtactaaattggagaacagattggcccttggtcctgacaaggctggatgccccagtgtaggggaatgccaggacagggaagcaggagtgggtgggttggtgagcagggggaaggggcataaaataggggggttttggaggagaaactaggaaaggggataaaatttgaaatgtaaataaagaaaataatctgataaaaatgaaaccaaacaaacaaaaaagttactgtatcatatacataaaactatcaaaccctttgtctaacttgatttcgcaagaacaacaaagatagaggacaatttcccaaaaatttataaacaaagaaactggataataggttaaatcagttaataaaagccacacaagtaatagatagatttaggacttgaacacaaaccatggcaattcttttttcccattactttatttatttactcactttacatcctgattgaagctccccctctcctctcatatagccctttccccatacttccctctacttcacctctgagaagggagaggtccccctgagtaccaacctaccctggaacctcaagtcactgcagaactaggtacatcctcttccaccaaggccagataagacagcccacttaggggagtagaatccacaggcatgcaacagacttaggataatcccctgctccagttgttggtggacctgcatgaagaccaagatgcacatctgctacatatgagcaggggactgtgtttagcccttatgtgttctttggttggtcattaggtctctgggatccctcaagggtccatgttagttgactctctttttcttcttgtggagtccctatcccatttgggttcctcaattcttcccccaactcttccacaagactctgtgctctgtccagtgtttatcgatgggtctctgcatttgtttctgctgggtggagcttctcagagggcaattctgctaggctcctgtctatcagtctaggctgacagatataaacatagctggaactccaaggtagttgaaggaggaaagcagggctataatgtgtccctactgatcctctgaggacagcttggcacatcccttccccccccccaaaaaaaaagatgtcaggattgcattcttttgtctgtcaaacacagggcacctgtgtatccaggccagaagtgacaatatagctgtcaacagtgtcttcacatgttgtatcattatgacaaggctttaaccaacaaagagtcatcacagtctcatagtgtgtccctgtgaactgtagtccctgtgaacccaatatctgtgcagtcacagaagtgtttcctctatgcatagatagacctctatggagatatgtctaactggcacatacatcaaggttgtcttcacagtggtctccaaggaacctctttccataatggcactgtgttccaggatggaatcaatggctactcctgttcctgtgtgcctggataccacagtggcaattctgaatctgtccacttttaagttgctcaatgctgccattccctttcatgtgatcttgaatcaattacttttctttcagccaattttgtatgctgggttacttttttcaactaaatcaatgactttcaagctgataacctttgcaaagatccctaggcctttccagaatctatcacatactaattccaaatgattgagggtaggtggtcagtgctagagattaaaccgggtatctcaagcatgctaggaaaaccttgtacaactaaaccataatacagatctataatttccaaatgtttctgattcttaccagtcctcattttgagaaaaatgtagcccttcagacacagaagaatatactcattttgttgttggtggtggttttttggtttttttgagacagggtttctctgtgtagccctgtatgtcctggaactcactttgtagaccaggctggccttgaactcagaaatctgcttgcctcagcctcccaagtgctgggattaaaggtgtgcgccactactgcccagctaatactcaattttcaaatcctcatttcctgtgtttactttctcctacagttgatctgtatttgaggtggttaccttttctacacactcattgagcatccatcgtcttttattttatggaagaattcatattcaaaaggactgtttaaactcattaagacatagttttggaggatctggagaaatggctcaataattaacaatgtgtactgctctagcacaagatccaaatttggttcctagcatacacaggctgaactcctcacaagtacctgtaattccaacttcagggtatctaacttcctcttctagtgtctgagagtattacactcacatgtacaaacccacatacacacacacacacacacacacacacacacttcattaaaaataaaatctttaaaatgaaaagaaaatatatttgggtggcactagaaatatagctcagtaacagagttcttaagtagcaactcctaggcctggttttaaacactacaaaaaaaatcaaaacaaaattagaaaaaaatatttctaacaaaaaaatgaatgtactcttcgtttagtaatttaaaaggtgtattatatcacttgtgagcgagtaattgtagtaacgacaggtcaaagcaaaaagtttaacatataaaggtatttaaatttttatttcaaaaaagaaaaaaatagcctatttaggctgttttaccactgtgaaaaatgcctgagaaaaacagtttaacaaaatatagggtttattttgtcccatagtgtcatagattacattccatggtcagatggattcattgtttcctggccttggattaggcaaaacatcgtgatagaagggtatgaaagaatggatatattcatttcctggttatcagaaggtagagaattgaaggcctatactggtaggctttcttctttagctttctctttttaatccttcttcatccccaacctgttggatggtatcctccttattcaggatgggctttccttttttttttttaggacattttctttatttacatttcaaatattacccccatttctcgtttcccctacaaaaacctcctaccccataacccctccccctgctcaccaacccactcactcctgcttccctgtcctggcattcccctacactgggacattgagccttcacaggaccaagggcctctcctcccactgatgtccaacaaagccatcctttgctacatatgcaactggagccatgggtccctccatgtgtactctttggttggtggtttagtccttgggagctctggagggtctggttgattgatacttttgttcctccgatggagttgaaaacctcttcagctccttcagtcctttctctagctcctccatggggaaggggaaccttgtgctcagtccaatggttggctgagagcatcaatcactgtatttgtcaggcactggcagagctactcaggagaccgctatatcagggtctgtcagcaagctcttgttggcattcacaatagtgtctggttttggtggttgtgtatgggatggattcccaggtgggacgggctttccttaacacttccgcagacacatctaaagatgtgctttactaacatcgtagtgatgagggatgtctcagtccaccgaggttaggaacctagattaaacaatttaatcttgactttcctttcctttgttcttctgaaagttttttccttcttcttttatatttatttaccttttggtttatctctaaaactctctgtagttggttagcatttttattaatatcctttatacacttaaagagattgctaacccacacaagataacatattgaacatagcttagaaaagggaacatcatggaacaagacatgggtagagctacaaagactttgtgtgtgtcatcctttattactgaaaaaatgtataaattttcatcaaaagacaccattatttataggatccataatcaattaaaaaaacactggggaatatgtaatgatgcataccaacaaaatctgcattcattgtaaaatgtatcttgatttataagtgataaaatgagtgagtcgtagggttttaaaaattgttgtgtttgttttctaaaaattctgcagcagtttcattgtgaactgttttattttatggctgtaggataaactaaacatcataatgcagtccttcatctttttcttttcgattcatcataggtacggctggcagctgccttcgtcgcttcagtaccatgcctttcatgttctgcaacattaacaacgtttgtaactttgcttcaagaaatgactattcttactggctttccaccccagagcccatgccaatgaacatggaacccctgaagggacagagcatccagccattcattagtcggtaaggcactggtttagctttgacatttaccaattaccccttagtttagctagtaagaaatcagtgtaaaatggataatccatgatactcacccaagttaagtatacaagagtgatttttaatattcaacccaacattttagtttgaactatatttcttagagatcagcttttgactaagccctatgcaaaatattttaataaaaagagaactcagtcaagttattatgcaaatatccccatgtatatttcttctggtttttactaatttgggatgcatccagcttagaccaagtgctacaaaagatcaaactggaaaaaaaaatggaaaaagtataaggaaaggatgtttaatcctaagtgaagaaatctggagatatatgtctcaaagaaatgtgttttgaactggtctgtctttggtagattggtaaacaactagacacacatacagttttaaagggaaagtcatactaaggaaagaaaatgagaatgggtagtatatgaatgtatctagaatgtagtatttaaagttttcataggagaaaaggttagaagttagcttgggcacagatagcagaatgatttcactgccaatttaaagcttggaatttatttagtgcattataatgagtagcactacaagccctcaaccaatatttgggataaagttcagggaagattaaggagctatcagtgcacttgaattgtatagtgacagtcgtcaggtcacactgaacactattgctatggtcctgaggtaactggattagatcttgcaatgggaaacatgcatcccattattggagtaagctaaaattgggagttgaagtaatagatgagttttggcatgcttttaactaggccgggtcctagcaaacacataagtagatgctcacagtcagctattggatggagcacagggcccccaatggaggagctagagaaagtatccaaggagctaaagagatctgcaaccctgtaggtgcaacaacattatgaactaaccagtaccccggagctcttgactctagctgcatatgtatcaaaagatggcctagttggccatcactggaaagagaggcccattggacacgcaaactttatatgtcccagtacagggggaatgccagggccaaaaaatgggaatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgaatcaatcacttgagcatattagatagtgctttttcattgtgagcctgatgcaaggttctagtaaccacaaggaatgaatcattcattactgatattgactacaaagatgtaacctagtttggcttatttgcaaaatcattgtttcctttgtagcatagctacctaaatctctctctctctctctctctctctctctctctctctctctctctgtgtgtgtgtgtgtgtgtgtgtgtgagagagagcgagagagaaagaagagagagagagagagagagagagagagagagagagagagacatatagcatgcaagtgtgtgagggagtttttttcagtttcaactttatggagtaagagtttccataatatataatgaattgtgtagacaaattttgctaaattgacctccattatgtttcaagatgtcccctcatgttctttattaaagttttgatatgttcattaacatgtattctgtggctgtttttacttactttgtcatttttaaccacatctccgactgcctgggcacctgcccagctgttttgggtttgttgtacttacccaaatatggccaaatggctaataaatgtctttggcagaacaatagtgggtggatattgagaaaatatctgctttttgtcttttccagtttactagacattcttcttaccacaataatagcattactaagtgtctacctcaagttgggccctttgacagcaagtatgtagaacacactaagccaaactcctacatcaattatcacatttactacagcaagtgtgaatgcaaatttatgtcacaatggaaaataaaaatgcaatagctgtaattctacaatgtactgaaaggcttacagtttttgcttataaatgcattatgcttgagaaaagagagttcttatgcaaaaaaaaaaagattgtcaaagtgcatttttctcctcttctaatcactgaaaacagttgtcaagggcctccataataggaaggtttctgaagaagagcaattgctgttttctacgccctcactctgtaattcatatcctctccccctttcctttaccagatgtgcagtgtgtgaggcgccagctgtggtgatcgctgttcacagccagactattcagattccacactgtcctcaggggtgggactctctgtggattggctattccttcatgatggtatgaaacacccatcttcccttttctcatcacagctgaccttctatataagtacatttctcacaacttgaaccatcactgtcacttgcatagtaataaaaagctggaatcttaaataacctctgtccaagcacagtgctctcccacccgcattttctagagtcagtttttataatatgccctttgcttttgttgactgtttttgatgcagatacagttctcttacctttactcatagtcaaattcattgcattctaatttgtggccaggttaggtatatattattgaataatcactataatagtatatcacatatgtgttgttgaacattttccttatcttttcagcatacaagtgcaggagcagaaggctctggccaagccctagcctctcctggctcctgtttggaagaatttcgttccgctcccttcatcgaatgtcatgggcgagggacatgcaattactatgccaattcgtacagcttttggctggccactgttgatatgtcagacatgttcaagtaagttccttatggctttagttgaaatctaaatgtttcttcatagatactaggaaagagagattctattaatgggttgtttacccctagtaaattttaggaatttgttggagcaagtttttgagtcttacctcgttctccacatgtaactaacttgtaatacaaactttactttgtcttgtaactgtcgttacaggtggcttagtattagcctttcaataccaaaaacagtcaggagttgggatactaaagtgataccatctcaagaagtgaaactataatgtataggaacttataacataatttttgtgaatgtttttgggcacatcacctgagtctttgagggatgaaataacacataactctgaatatttcaatctctttaagtttgtctttatttttatgtattgcttttttcttggtatttttatttaaaatcgtattacgtattgctcataaactggctaaacttctcccatactataatattaagaatggttaaaaaatacaaagaaacaaatacataaaaataacagtagtggggacaatggtcacaaaaaatacatgtgacgatatagagaatgaagtttaaatatattgtggagtattattctgccataaagtattaaattatatatgaaactaatgaacatgatattcaaaataagccatacttagacaaatatccatattttctctcttattcctggactctgggttttacacacacacacatatatgcacacatgtatgcaaatgaagtgaaagcaagattgtctgggaaaagggaaaaggaaagggactatgggaatgatagagagaaagggaagggaatgggggatgaagttatattgtaagttttctttatggaacacatcactacatgcaatgaatgcaaggcaacaaaatttttgttgcatacctgtgatcagtagtagatattaagccatagcaatcaatgtatattaagagattaagggcaaacgtgatattgctcagcaggttaagacacttgcccctaagccccacttagttatgtgccttggacccacacagtacaaggaagagagcaacttctacaacttgttctgacctttacatacatgctgtgacaggtatacttggacatactgacaggcagatagacagacaagcattttaaaatgaaaacatacacttaagtcccttgtaaagctgtttaacaggaggagaatgtctaaatatgaattcatccctataatagaatttaggtagcaaaaatggaaacacaaacctgattgtttcattttttttttatttcctagcaaacctcagtcagaaaccctgaaagcaggagacttgaggacgcgtattagccgatgtcaagtatgcatgaagaggacataacttgttgaagagttccttgtgttttttttaatgtgattatatatatatacatacataaactattatatgtgattcccaggatgcaatgtctcactcactctccccacctttaccactgctcccaccaatggtgctaatatcctctatgacgaagagaacatgctgactagcaaccatgaagattcagatgtacctcagcaatgtgccagagcaagggctccatccttccttatgaaagcaataggaaagtgactatacttctggggctccaataaattccttcaaggattgtaaggcgaagttcatatgctttgcctagttactgaaatggcacatcaaaaattcaatgaagagaagagttatactgagtaaaagtactgagtgcggtttgaggaagtattctttttcatggtgctactaatcctaatgtaccacaggattttaataaaagagtgttcatcttactttgctttgtaagtaaaagaaatgtgtatatgctgtaaacaacctcttagttcaaaatgttgagtcatttagatgtgatctggcataaaccctactttactgaaaaatctatgaaatcttactctatagacagcaagatatacatgtgagaaaatgtatcctttcatcgagttattactgaaagcaaattaattgggagtttttaaaaaaaaatttaagtaactttgaccagaattttagtggttcatataaaacttatcaaattatcatatccaatgaagcaatctcttattttatgtcttgttttacttaatcctgacagttttgagaaaaaaaataccaaattaattaataattcttattattctggtgctatgcaagaattattctcctgtgggctcatttgtgtaagaagacagtatttgcttagtcttctcccttcaattagaaaaagccaatggacttttaaaacctttatattttaaacatttttattaagaatagtcataggataccttattttcttaactgtcatcttctcactgaattttttttaatttaccagtatcaacttaattaaagatatatgttataattatggttcattgtctctttctttagcataagaataaaaccatgttcatttacattggtacatcaattatttctttctcaggcaattggttcctgtgtctttgttcattataaagcagaaaacatatagtaagggaaactttttcccacggggaaaaataaactaatggaagatgctcttgaagtacaaaatttcttgataatgtggtatcggtggatattaaagaacaagtttgtgtttaggaaagagttcattaataatgcttaaattaaattagtgagctaatatccctaataaataagaatgaaccacatgtagctcccaaaaacaaacacggacttgctaaaaaatcaaaggatttttaaagcttttataataaagtttgtgtaatagcaaaaaatacagcaactgaaacaatttttaaaattttatatcccgatatgaacctatgggcaatctgaagcttagagattatagtggtaatttttagaatctaagcaataagaactattttagttttatttttttcatgtagatcaacccatgcaaacactgacacgtaattctttttgttttattattagctattttccccgtttacattttcaatgctatcccaaaggtcccccatacccaccccccaatcccctacccacccactccccctttttggccctggcgttcccctgtactggggcatataaagtttgcaagtccaatgggcctctctttgcagtgatggccgactaggccatcttttgatacatatgcagctagagataagagctccggggtactggttagttcataatgttgttccacctatagggttgcagatccctttagctccttgagtactttctctagctcctccattgggggccctgtgatccatccaatagctgactgtgagcatccacttctgtgtttgctaggccccggcatagtctcacaagagagagctatatctgggtcctttcagcaaaatcttattagtgtatgcaatggtgtcagcatttggaagctgattatgggatggatccctgcatatggcaatcactagatggtccatcctttcgtcacagctccaaattttgacacgtaattcttactggacccctaaatccatccccaagatgattttcaacatgggatacatttcaaggttgttccttgagttgcaagaacaaatgtggattatattcttcactcatatatgctccatgaacagataacatttgtgtttcttaaagcctctcctgttctccagccctgtcgagttgagcacacaaacccatcccagtaaaggactctgatgttgttcactgttccttgacagtgattactcaaaaacttttatgcatctaggaattatctttgctaagtgttacaattcatggttttccgatatgggccaagagtgaaaacatggttctgctgaactggctcattactaccaaacatgtttatgtaccaaatagggttttaaaagttactaaatttgtttaatgattcaagtagagaaggagcaagtccaaatgttctactgctgtatggaagaattgttccatggatatctctaacttttggaagactagatagtcagagacagacagtgtcagagaagacagttgtccccctttcttagcttgatcagacctaatatgctggtgtagtattctttgcatccaacaggtttttttgtttgtttgtttgggtttttttttttttgacagtttgtgcttccagagtgttttcccctaccaatgaaatttgaaaaccactttccagttttatggtgccaatgaggttctttgcctcaattagcatggttaattgaaaactaaactagtcactccaagctaagttaccagtttatacagaggttaacacaagatggtactgttgcctgtcaaaatgcacccgtgtgtgtaaagaggagttgagcccattgttttgtttgtttgtttggttggttggtttgttttgtttttattacgtattttcctcaattacatttccaatgctatcccaaaagtcccccataccctccccccccacttccctacccacccattcccatttttnnnnnnnnnnnnnnnnnnnnacttccctacccacccattcccatttttttggccctggcgttcccctgtactgaggcatataaagtttgtgtgtccaatgggcctctctttccagtgatggccaactaggccatcttttgatacatatgtagctagagtcaagagctccggggtactgcttagttcataatgttgttgcacctacagggttgcagatctctttagctccttggatactttctctagctcctccattggggaccctgtgatccatccaatagctgactgtgagcatccacttctgtgtttgctaggccccggcatagtctcacaagagacagttatatctgggtcctttcagcaaaatcttgctagcaaaatatgcaatggtgtcagcgtttgtaagctgattatgtggtggatccctagatatggcagtctctagatggtccatcattttgtcacagctccaaactttgtctctgtaactccttgcatgggtgttttgttcccaattctaagaaggggcacagtgtccacactttggtcttcattcttctagagtttcatgcatttggcaaattgtatcttttttttcttttctttttccattttttattaggtatttagctcatttacatttccaatgctacaccaattgtatcttatatcttgtgtatcctaagttttgggctaatatccacttatcagtgagtacatattgtgtgagttcctttgtgattgggttacctcactcaggatgatgccctccaggtccatccatttgcctaggaatttcataaattcattctttttaatagctgagtacttacttactccattgtgtaaatataccacattttctgtatccattcctctgttgaggggcatctgggttctttccagcttctggctattataaataaggctgctatgaacatagtggagcatgtgtccttcataccagttgggacatcttctggatatatgcccagaagaggtattgctggatcctccggtagtactatgtccaattatctgaggaaccaccagactgatttccagagtggttgtacaagcttgcaatcccaccagcaatggaggagtgttcctctttctccacatcctcgccagcatctgctgtcacctgaattttttatcttagccattctgagtggtgtgaggtggaatctcagggttgttttgatttgcatttccctgatgattaaggatgttgaacattttttcaggtgcttctctgccattcggtattcctcaggtgagaattctttgttcaaatctgagccccattttttaatggggttatttgattttctggagtccaccctcttccgttctttatatatattggatattaatcccctatctgatttaggataggtaaagatcctttcccaatctgttggtggtctttttgtcttattgacagtatcctttgccttgcagtttcatgaggtcccatttgtcaattctcgatcttacagcgcaagccattgctgttctattcaggaattttccccctatgcccatatttttgaggcttttacccactttctcctctataagtttcattgtctctgattttatatgaagttccttgatccacttagatttgaccttagtacaaggagataggaatggatcgattcgcattcttctacatgataacaaccagttgtgccagctgtccactctctccatacctattcaacattgtacttgaagtcctagccagagcaattcgacaacaaaaggagatcaaggggatacaaattggaaaagaggagcccattgttaaagatggcaatgggtttgtatgaacctctatcttcttatcccatgttttaagcttcatgtactctttcattgtcacaaaaatcagtagaaaatagttctaaatatgtctcagtttctcactatctacatttaaaataaaaaaggcatcttcaatgtcaaaggttgcacttccttagcctctcaacacacaagtaaagaaaccgtttttgtttttgttgttggtttttttttttttttttttttttggtatggccaagactccagttggctttagtgggcagaggatctgtttttctcaggctgtgttattcaacccatattcacctctaaacagcttcaaaaataagctgaatagtgtttttaaaaatcacatgccattgttgatttaagtgcagtactttcatgggttttgtttgtttgaaggtttctgtagtagtaataattcatgcattgatacagtaaaggacttgaatctagatactcctgtctgccaaaatgtgtgataacaaactatcattggatgcttattagccataatataccacaatagatagcaatccagtataaatctaacccaatgatatgtggccatcaggatatgtactaggtaaaatagtcatgctacctagtcttggattaccatctcttcttaactctagtacaaatctcaggtattttcctgcagtggatattcagaagaagcttgtttgcaaacttcttcaatataagaacagacaaaatcccattaatgtaatcttacctctctatctctctgagaagacacttgccaaacccctgaacctaaagacaagcaagttgctggtagtttacctttattcttgttatcattattcactacttctcattcacattacaaccttccccctgctttttgcacacagaggattcgaaagccctctactggatactcaagtagaacagctaagggacaggtgagtgacactgctgggattaagatattcattttcaaagcttcttctctgtgaggtcacttcaggttgtattgtgcccctgaatggactgtccagatagctcttggggagacatgctcttcttatctcctgcctcatcccagtcatcaccttctaataattgttgatggtctaggtgtgtctataagttggctcatgctattctggtagccatagattcattaattgctgtttttctaattaaactcttacctaattattataagcgtattgtctgaatgctattaaaaatgtacttattacagcactgactctagttttcaaaatgtagagctggtacctattgatggttaattgcaattaatttataacaaatatgcatattcatgattaaggatcttccacttgaatgaaaagataagtccaccatttattttaaaacctggcatggaaaaatgtattgggacacatttcttaggggaaatgggaaaaaatgtgttcattatggtgcaaaattacttacttttcctaaacattggatctttgaataatgtactttgacttctttctgttggccatttggcttggatggtcctactccaaatgcaaatcaaaacaaaacaaaattcccatgtcccatgagcagactggattctgatctttggatgcttactagcttctgatcttccttcctcaaaagaaactcttgatagtgttatttccaagagaaaatctgccaagttaggtctacaagcctgcaagccaagaaaattaccaaaaatgttactagctgagaaatggggagtttactcctgcttttcttgcttcaaaagcatctgtctaatttaagtgtccagaagctcttccaatctgctgtccttgtgtccatctaaggtgccagagaaaacactcctggtaaaaaatatggaaaaaaaaaagactgaaattggaagccacaggttgtctgagactacctccttatttcacccagggacagacatgtagaacctaccaaaaataccatgcttcattttaaagtgaaattgtttttctagttcatttcctcagggtcagtaaggcatttgctaatgccaattctgccataagacacagttggaagcccagatttcacatttctgtgtcttcatttgacacaatagtatgactgttgctcagcatctcctaaagtgactcggcagccagcagggagagtagagcttaatgtctataagacttcattaaagctccattcttcccatatctcacttgatatcacttcccatatctctctggtgtactcaagtgatggatctctaacttacagatacataagataagccttggaatagttaactacacttccccaaatccaagacaaatttatttttcactcaagatttaattatcaaccttttgcactgaagttaacctattttacacaattcagaatccagggatggagatactgttgagttagcatccttcttgcttaatacatgctcaacctcaggatccattgccaacattacaacaccacacagacacacagacacacaacaaacaaacaaacaaacaaaacaaaacataagaattctaagtgtggtagaaattaataagggtctactacagggcttttctgcctcatgagaagtgtgttttgggagtcttggttcccaagtaagaatgaatgtattttcagttgcacttgcagtacatgggactctttcaaattactccttagaaatagagagcttgtaatgagtccactctagcagaggggattaatgtccatccactctatctccatagacacagaaaactgtgaatctgtcttgatttccatcttgtagctttcttgaggcatttgagtacagataagctactggagtttgaattttctgtcctgcaaaatctccagtgttactagagcacaggtaaggaccacttgtataattctgaaaccaggtactactgacaaagcagaaactattcttgacttccaactggacagttcattatattttattgacacggcataaacacagagaagaaactctgctttcttacctataacctaactcacctgtaccttgacttcctcttttgaatctcctcagcagaaaatgagactgggagtctagggaacaaaacaagccaagtaggtcacatggtacatagtttatgagattagagaaacagaaaagggttaaagatgaatagagaatccgcatcaaaataaagccatgcttaacttatgacttttcactttgcaaatctatctggttttacttcatctactttgaaactctttttgctaagtacataagtatgtctttgtattctgtctttttcattagataatctccttttcagcatgctattggtgatgtagtaaacaaaagttagtattttgtaataaatatttgtatctttatatatattaattggttgttatatttatttacatttcaaatgttatccctctccccagttcctctacagaaaaccctatcccatcttccttccccctgcttctataagggtattcccccacccacccatgcactcaccccgtcccatccttgaattccactacactggggcatcaagccttcacacgaccaaaaaggcctctcctcccattgatgccagatgagaccatcctctgctacatatgcaggtggagctgtgagtccctctctgtgtgtcctttggttggaagtttagtccctgggagctttgcgggggggtgggggggttctgcttggttgatattgttgttcttcctatgggattacaaacccttcagctccttcagtccttcccctaactcctccattggggtacctgtgatcagtacaatggttggctgcgcgcattcgcatttgtattggtcaggcttattaattaattgatgagttaattaattaattatatattattatattttgaaaaatacattacattgataccaatatagtcacccagcttcctttatgttaatatgatcaagagacttttttccatcattttacttaacacttgtttctgtatacttaaagtacatatctaaagggtgtgtatagatgaaaacacatatttgtagaactaggcaatattgctatagagcttgtgtctttgtatcctgggctggccttgaactaagaatcttgctgcctcaatttcccaaagagttgcattgcagcaatgtgccaccatgcctggtttaatgaaatttgctattgatctaagtagaatttttcagtttttgtgccttggttcaaattaaatatgttttctgattccatttaatcaccttcataacatattagttacctttcttagactacagtctatagtatatacctttttatttttattttttattttattttttgtttttttcaagaaagggttctctgtatagccctggccgtcctggaactcactttatagaccaggctggccttgaactcagaaatctgcctgccttggcctcccaagtgctatgattaaaggtgtgtgccaccacagtgtggccttaatatactcctttaacttctaacagtttattctcacatcatataataccatctcacacatgtaagaacattacattagcatactttcaattttctgatcttgaggtttggttgattattttaatatactgtactttctacatattgtaagtctacatgtccttgatattattttgcttaaataatgtattaccttgtcattatatagaactcaaattatattattttcaaagtataatttaatggttttaccatattcataacttcaatcactattgtattctaattccagaacatttttatcacctgctgaagaaactctatgcccattagctgttacaccctgtttctccatcttccactccttcagcttgaggaaaacactaatacatatacatctttacagattatctattccagacatttcatagaaatgcaatcatattgtctatgatcttttgccaatgccttcttaaatttactgttgtgccatgtgccaatagcgcaattctttggtttttaaaattgaggtgtaatacatacacagctaagcatttaaggcaaaattttaagcagtgtttactacatccacaaagttttccaactatctccacctacttgcaaaacattttcctcagcccaaaagagagccctatatccattaagcagtcttaagtcctctctaaagaccctaatagccactaatctttctgtttctatggatatactaattttggatgttgcatatgaagaaagtcatggaatactcaaagtttctcacttagtttcttgcatttagcatgtcctcaagcttcattcacattagaatatgtttgagttcctcattttgtgtgtgtgtgtgtgtgtgtgtgtgtgtgtgtgtgttgcataagaatcaattgtatggataaaccactgttgtttatctgtgacattttaaatacagctgacagctgtgttgtttctgctttttggtggttgtgaatattgctttgaaatccagtgtgcaaatatttgtttcaaattttctttatcctatcagatatatagtgaagaatagcattctctatgtatgttcttgagaaactaccaaaccactttcccagtagctacattattttatattcctacttacaataccctagggttccagtttttctacattcttacccaaaattacatctttcttctcttctctcctctcctctcctctcctctcctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 81 - DNA, 6129 bp, Mus musculus
agaaggcaaagtgctcctgagagatcggctttggggaggggaggggggctctctcttattttaatcgcttcccctcttataaatctcttcccccccaagtgcaccagcataaccgggacactcactgtcccctttctagctctcttctcaataacccttcaagattatgtcaatcggtctgaagggacctgggattccctgcgggtgctgacggagctgcgggagccagagaagaatgcaagtgcgtggagtgtgcctggctgccggctggttcttactggccctgtgtctgtgggggcagcccgcagaggctgcggcctgccatgggtgttcttctggatcaaaatgtgactgcagtggtataaaaggagaaaagggagaacgggggtttccaggtttagaaggtcatccaggtttaccaggatttccaggtccagaaggccctccaggacctcggggacaaaagggtgatgatggaattccagggccaccaggaccaaaaggaatcagaggtcctcctggacttcctggatttccagggacaccaggtcttcctgggatgccaggccatgatggggctccaggacctcaaggtatccctggatgcaatggaaccaagggagaacgtggatttccaggcagtccgggctttcctggtttacaaggtcctccaggacctcctgggatcccaggtatgaagggggaaccaggcagtataatcatgtcaccactgccaggaccaaagggtaatcaaggatacccaggtcctcctggaatacaaggcccacctggtcccaagggtatatcagggccaagtggtcctccaggaccaccaggtttaatgggacctcctggcccaccaggcccaccgggaccaaaggggaatatgggcttaaatttccagggacccaaaggtgaaaaaggcgaacaaggtcttcagggcccacctggtccacctgggcagatcagcgaacagaaaagaccaattgacatagaatttcagaaaggagatcagggagttcctggtgatagagggcctcctggacctccaggaatacctggtcctcccggtcctcctggtggtgtgaaaggtgaaaagggtgagccaggagaggcaggcaaaagaggtaaaccaggcaaagatggagagactggccaaccaggaatcccaggtttgcctggtgatcctggttaccctggagaaccaggaagagatggtgaaaagggtcaaaagggtgatattggcccacctggacctcccggacttgtaattcctgcacctggaactggtgtgactatgggagaaaaaggaaatatcgggttacctggtttgcctggagaaaagggagagcgaggatttcctggaatacaaggtccacctggctttcctggacctccaggaacagcagttgtgggtccccctggtcctcctggatatcctggtgaaaggggccagaaaggtgatgaaggtccccctggaatttgtattcctggatctcctggacttgatggacagcctggggctcctggccttccaggacctcctggcccccctggcccccagttgccatccagagatgaaatctgtaaagcaggccctcctgggcctccaggacctccaggtgataaaggactccaaggagagcgaggagtaaaaggtgacaaaggtgatacttgcttcaactgtattggaactggcatttcagggcctccaggccaacctggtttaccaggtctcccaggtcctccaggatctcttggaatccctggagagaagggggacaaaggacaagctgggataactggtccgaaaggattgccaggcatacctggacctccaggtgctccaggctttccagggtctaagggtgaccctggggatgtcctcactcttccaggaatgaaaggtgacaaaggagagttgggtttccctggagctccagggcttcctggtctacctggtagtcctggaaaggatggtttgccaggactccctggccccaaaggagagcctggtggaattacttttaagggtgaaagaggtcctcctgggagcccaggtttaccaggtctcccaggaaatatgggacctacaggcccagttggttttgggcctccaggccccataggcgaaaaaggcatacaaggtgtggcaggaaatccaggccagccgggattaccaggtgatcctggacttccaggccaaccaggcctgccaggaatacctggtagcaaaggagaaccaggtatccctgggattgggcctcctggaccacctggtcctaaaggttttccaggaattccgggacctccaggagctcctggggcccctggaagaatgggtccagatgggcctcctgggccaccaggcttcccaggaccaaagggagagccaggatttgggttacctgggccacctgggccaccaggattcccaggtttcaaaggaacacctggtccaaaaggtgatcgtggtttcccaggaccttcaggtcctccaggacgcactggcttggatgggctacctggaccaaaaggtgatgttggaccaaatggacaacctggcccagtagggcctccagggctgccaggaattggtcttcagggaccaccaggaccaccagggactccagggccaataggccaacctggcttacatgggattccaggagagaagggggacccaggacctcctgggtttgatgttccaggactccctggagagagaggtagtccagggctccctggagcccctgacatgtgataattttacatgcattgattatggatgaagaaatttggtgtgctttgttgactttaggtgatgatggcatgcaaggtcagccaggtctccctggccctgcaggagaaaagggcggtaagggagagcctggccttccaggtcctcctggaccaatgcatccagatttcctgggatcgaaaggagaaaagggtgagcccggcttaccaggtattcctggactttcaggaccaaaaggctaccagggattacctggagacccagggcaacctggactgagtggacaaccaggatcaccaggactcccaggtcccaagggtaatcctggtctccctggtccaccaggacttacaggacctcctggaccaaaaggaaacattggtgacatgggttttcctggccctcaaggtgtagatgggccccctggacctcctggatttcctggacaacctggctctcctgggttacctggccagaaaggaagtaaaggagagcctggggtttcaggcattggacttccaggtcttcctggcccaaagggtgaacctggtctgcctggatatccaggaaacccaggtatcaaagggtcggtgggagagactggtcttcctggattaccaggaaaccctggagcaaaaggtcaaccgggcctgcctggattcccaggaacaccaggacttcctggaccaaaaggtatgaatggtcctcctggtaaccctggctttcccggagaacctggtcctgtaggtgccggagggcgtcctggaccaccaggacctcctggtgaaaaaggcaagccaggtcaagatggcattcctgggccagcaggacaaaagggagaaccaggacaaaagggtgatggaggatcacctggacttccaggaaatcctggccttccaggttcaaagggtgagccaggctttcagggattccctggtatgccaggtcccccaggtcctcctggttctcctggtcaagctttggaaggtcccaaaggaaaccctgggcctcaaggccctcctgggagaccaggtccaccaggtacagaaggtcctcgtggaccccctggaaatggaggtatcaaaggagagaggggaaatccaggcccacctgggcagccaggcttacctggtttgaaaggagatcaaggaccaccaggactcccgggtaaccctggccggccaggtcttaatggaatgaaaggagatcctggtctccctggtgttccaggattcccaggaatgaaaggacccattggagtaccaggctccactggccctgatggggaaccaggtcttactgggcccccaggtcctcctgggttgcctggtccttcaggacagagtattgtaatcaaaggagatcctggacctccagggattcctggacaacctggattaaaaggtctaccaggacttccaggccctcaaggcctaccaggtccaattggccctccaggagatccaggacgcaatggactcccaggctttgatggtgcaggagggcgcaaaggagacccagggctgccaggacagccaggtgcccgtggattggatggtcccccaggaccagatggattgcaaggacctccaggaccccctggaaccacctctgttgcccatggattcctcatcacacgtcacagtcaaacaacagaagcaccacaatgcccacggggaacagttcatatctatgaaggcttttctctcctgtatgtacaaggaaataaaagagcccatggtcaagacttgggtacggctggcagctgccttcgtcgcttcagtaccatgcctttcatgttctgcaacattaacaacgtttgtaactttgcttcaagaaatgactattcttactggctttccaccccagagcccatgccaatgaacatggaacccctgaagggacagagcatccagccattcattagtcgatgtgcagtgtgtgaggcgccagctgtggtgatcgctgttcacagccagactattcagattccacactgtcctcaggggtgggactctctgtggattggctattccttcatgatgcatacaagtgcaggagcagaaggctctggccaagccctagcctctcctggctcctgtttggaagaatttcgttccgctcccttcatcgaatgtcatgggcgagggacatgcaattactatgccaattcgtacagcttttggctggccactgttgatatgtcagacatgttcaacaaacctcagtcagaaaccctgaaagcaggagacttgaggacgcgtattagccgatgtcaagtatgcatgaagaggacataacttgttgaagagttccttgtgttttttttaatgtgattatatatatatacatacataaactattatatgtgattcccaggatgcaatgtctcactcactctccccacctttaccactgctcccaccaatggtgctaatatcctctatgacgaagagaacatgctgactagcaaccatgaagattcagatgtacctcagcaatgtgccagagcaagggctccatccttccttatgaaagcaataggaaagtgactatacttctggggctccaataaattccttcaaggattgtaaggcgaagttcatatgctttgcctagttactgaaatggcacatcaaaaattcaatgaagagaagagttatactgagtaaaagtactgagtgcggtttgaggaagtattctttttcatggtgctactaatcctaatgtaccacaggattttaataaaagagtgttcatcttactttgctttgtaagtaaaagaaatgtgtatatgctgtaaacaacctcttagttcaaaatgttgagtcatttagatgtgatctggcataaaccctactttactgaaaaatctatgaaatcttactctatagacagcaagatatacatgtgagaaaatgtatcctttcatcgagttattactgaaagcaaattaattgggagtttttaaaaaaaaatttaagtaactttgaccagaattttagtggttcatataaaacttatcaaattatcatatccaatgaagcaatctcttattttatgtcttgttttacttaatcctgacagttttgagaaaaaaaataccaaattaattaataattcttattattctggtgctatgcaagaattattctcctgtgggctcatttgtgtaagaagacagtatttgcttagtcttctcccttcaattagaaaaagccaatggacttttaaaacctttatattttaaacatttttattaagaatagtcataggataccttattttcttaactgtcatcttctcactgaattttttttaatttaccagtatcaacttaattaaagatatatgttataattatggtt

SEQ ID NO: 82 - protein, 840 aa, Mus musculus
MQVRGVCLAAGWFLLALCLWGQPAEAAACHGCSSGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSPLPGPKGNQGYPGPPGIQGPPGPKGISGPSGPPGPPGLMGPPGPPGPPGPKGNMQFQGPKGEKGEQGLQGPPGPPGQISEQKRPIDIEFQKGDQGVPGDRGPPGPPGIPGPPGPPGGVKGEKGEPGEAGKRGKPGKDGETGQPGIPGLPGDPGYPGEPGRDGEKGQKGDIGPPGPPGLVIPAPGTGVTMGEKGNIGLPGLPGEKGERGFPGIQGPPGFPGPPGTAVVGPPGPPGYPGERGQKGDEGPPGICIPGSPGLDGQPGAPGLPGPPGPPGPQLPSRDEICKAGPPGPPGPPGDKGLQGERGVKGDKGDTCFNCIGTGISGPPGQPGLPGLPGPPGSLGIPGEKGDKGQAGITGPKGLPGIPGPPGAPGFPGSKGDPGDVLTLPGMKGDKGELGFPGAPGLPGLPGSPGKDGLPGLPGPKGEPGGITFKGERGPPGSPGLPGLPGNMGPTGPVGFGPPGPIGEKGIQGVAGNPGQPGLPGDPGLPGQPGLPGIPGSKGEPGIPGIGPPGPPGPKGFPGIPGPPGAPGAPGRMGPDGPPGPPGFPGPKGEPGFGLPGPPGPPGFPGFKGTPGPKGDRGFPGPSGPPGRTGLDGLPGPKGDVGPNGQPGPVGPPGLPGIGLQGPPGPPGTPGPIGQPGLHGIPGEKGDPGPPGFDVPGLPGERGSPGLPGAPDM

SEQ ID NO: 83 - DNA, 277616 bp, Homo sapiens
aggagatgtttactcatttgaaagtcatctcttgatcacctatgctcagcctggcagtatcctggacatcctaagtacaaggttgaagaatgtaacgtagtcatataagcataggaatcttaccaccacatggatgtgctaccaaagaggcccaaagctccttggaagcacaggagaaggaagaataaattcattctgaagaggtctggaactgtttcatagaaaaaattatatttggtctgggtattaaggattgagtaggagttcattagatagaaaagaaggtagaaacaatacagaaggatattccagagagagggactgcatatccaggggcaaagagatgtgaaagaatataaagtggtttgggaatggtgagaagttcagtctgaatgaagtgtaatatacaccatgagtttggaaagaaggactggtaggaagaaacacacagacatgaggctagaaaagcagttgggtcagaaaatgaaagcccttaaatgtgccaaaccaagtagtatgcattttatcctggaagaaagaagaaaccaataaaggcattaaatcagaagataccataattgggtttgttgttagtaaaataactctagtggcaatgtagagataaggatggagtcaggaggtagaaaaaccagtcaggaggctactgatgtatgaagtttgaaaccaacagaatatgaatggaaaagccagattctacagatttttggtaaaattatcaaaatttggtgagaattttggaaataatgaaagctgatggctgcttctgtagcttcttgctgaaacttggtggatggtgatgacatttaacaaaaataaaaaagatcacagctggttggagtgtcatgggaaggagaagaaaacaatttcacctttaactatactgtatttggggcaataaaaataataatagctggctttggctgagtgcctatactaaactccaggcactgttttaagtgttttgtatatatcaactaattgagagacaggtacaaggggttagtaggcaaatggaaacatagatttagagctcaaaagagatgtcttggctggggatataaatttgataatcatcactatataggaggcatagttaaaaccattgaggcaagaagacagtaaagaattaagttttggaaaaaatccaccattttaggacaagagactgataaagattataaattccataagagcaaagttcatggctaacttgttcaccactgtgtcactagggcctggcatactatctggaatatagctgttgctcaataaatatttgttgaattaatagcataaataaaaagatcagagaagtataaggagaactagtgaggcaagtttgtgtcataatcccaaaagacacaatcctgaatgctataatcccaaatgttgaaatcccaaagatcaaaatccctaaagtctaaatccctagagtctaaaatctttaacatctaaaatcctgaaaatcacaatactgaaagattaaaatcccgaatgttgaaatcctgaaaactgaattctggggaagtgtgtttttggtcgcagatgggatggttgtgccatgttagttgcatcatgtgaagtggaactatttccttgttattgtctttatttagaaattaagtatggtttaagaagatgcataacgggtgccaagttgacaaggggtggacttgcggacttaattttaggttcaattggactggattaaggaatacctagaaacccggtaatgtattattttaggtgtgtctgtgagggtgtttccaaaggagattcatgtatgagtcccagtggataagctagggaagatctgccctcaatgtgggctggcaccatcccataggctagaggctgggagagaacaaacagagaatgcaaattggtctctctctgagagctggggcagacttttcttctgttgcgttggacatcagaaatttgattccatgaacgtgtattatcacaatgttgactttctgtgtaagcattgtgtgtgtatgtaaaaatgtgaaaacctcctcagtgaatgaagagatgtctttttgtacacccgcatttgtgaaagataaaatttctcaagatcttggctctttggatgactgcatatacggtggtcacctatggtggttttttatctatcttgtcaaaagacttttgttgttcatcaaggtatttcagatgactacagttataaagctggatgcacacaattaccaaccatagtgatatgtctttatacattttccttttgacctatttctttgtgaatacagttcaactacttataactgtcatacaagtgtgactgtcactagtatatactaagtgtttatccttacaaaactatgtatgttattattgtctattttattatgtaaagtgacctttggaatgttctgttgtgttttatgtttctcaaacaactatccttttaaaaatgtaagtaaatatcttttaaataatttttaaaattactttttccagaatatttttgggattttgatctttcaggatttcaacatttagaattatgggattcaggattatttatttcaggattattaccagctccctagtgaggtataatgtcttaaaaaacaagaggaggccgggtgcggtggctcacgcctgtaatcccagcactttgggaggccgaggcgggtggatcacctgaggtcaggagttcaagaccagactggctaacacggtgaaaccccgtctctactcaaaatacaaaaattagccgggtgtgatggcgggcacctgtagtcccagctactcgggaggctgaggcaggagaatcacttgaacctgggaggtggaggttgcagtgagccaagactgtgccactgcactccagcctgggtgacatagtgagactctgtctcaaacaaaaaaacaaaaaaacaaaacaaaacaaaattaaaaaaaaacaaggggataaagaagtatcagagtaactgggaaatgtcagataacacagtgaagtcagatagaatggggactgcaaataagccattgggtttggtaattaggcagccattagtagcttgaaagagggctgtttgcctggagtagactcagttgagactataataggttgaagggtaagtggttggtgatgaagactagacaatacccaggaacttgggggtaatgcaattgaagaggttagagttattaaagtaaatgaagtgattttgtttaaattcattgttataacggaggagaattcaatattgtttatagaagaaaaatagaaaccctaggaaagggatagattaaagaaagagagttgataattgctcttagctaattttcccattactattttcccttgagcatgcttatcaggtcttctatttacatttaattagactttaaaccaagtaaaagccctatgatctgcctcactgggacattcaggcagctataaaggacttgatagtttaatatagcctgatgttatcccacgatgttctttttctatgtgtatgtcttgtcacctacacagtataagacaagtctatactccaagtatattactgtatactgttttttctttctttttcttttctttttctctttttttttttgacaaggtctagctctattgctcaggctgtagtgcagtggcatgatctcagctcacctgcaacctccaactcctgggctcaagccatcctcccacctcagcctcccagtagataggactataggcgtgcaccaccatgcccagctaatttttgtattttttgtagagacggagtttcactatgttgcctaggctggtcttgaactcatgagctcaagcaatccacctacctcggcctcccaaactgctgggattacaggcatgagccactgcacccagccatacttttaagattattctaacagggagctgtggtgtgtgcctatagtcccagctactcaggaggctgaggcaggtggattgcttgaggctgtggtgtaccataattgcacctgtggtaaaattatgaaataatccatataattcaggcaaataaaaaccaatattaataattgaggtcaatcagttttttctattaatgagataataagggaaacagtatactttactccagtcatatggcttgattatgagcttacagaatataggagcatatttattgaagactccaaactatgcttaaaaattaaaagattgttggcacttagagtcaacacaattcccctcatgcctgaacaaacattagaaaatgactgtttttgtaaaaccaattttcttaaactaggggtacttttttcatgccatagtttggcagtctagtgaagcctatggactcctttttagaatactattttttttttccttttgagacagggtttcactctgctgcccagggtggagtacagtggctattcacaggcacgatgatggtgcgtcacagcctcaaacttctgttctcaagcaatcctcctgcctcagcctcctcctaagtagctgggactacaggcacacaccacagcaccctgctagttttagaagtatacaataaaatacataggattacaatggaaactgattacactgaaatacaatcattaaaatgtataataaaacaatttttgaaatggttatatatttgcttctttagtaacactttagataataacatctattatcccctcctctatcttaaaatatatttgaatttcacctataaataatgtaaatatattatcatctatggattatctatttacagtcatttgatgatttacttaatagtgtactcatacatttctatcagtatccttagtcatcccaagatatatatatatatatattatatatttatatacacacatacacacacgtatattatatgttgtgatttttcatagctagctgatataggatatttgctagcaggtaaagtagaagagtactttaaggatttatagagacacagccccagataatgcaaatattcctcttggtctttagaactggaagagatcgtctccatcgctgaactcccttaacataatattcatatattgatgactactatacgactgaaaatcacagcagaaaggaccaacctgggcatgttacaactttaaagaaagaagttgatatttcaatcagaccttgatttgagtgcagctaaaggcattttacctatgctctctgcagaaggaacaatagaaatgttttctctccttaccctcctcccaacccaaataagtatccccctaggcttttgactttaagtatgcttgattgtattagaccttttcctgaaagctcatttggagggggcaaagtgtgaagaaaacataaggatctgactacttcgggatatatgttttttcctagatatattggctgatggtgagatttgtatctttctagacatttcgctaacacgatgcaagtacatgtagataataacttatcattaagcatcctatcttctaaggaacataatgaccaccattgtctgagaaagcaaattcctagagagttaggaactatgtttaaataaatctttgcatgctgtgcgtggcctagcacagccccttagatagttaggcgcctaacagccaaagacatggatgttctgagatcctagattctattttatgcagataaattgtgcaaatatttcacctgaatgaagatcattactcctttaaagtaaatttaatggaagctcattctttaacatggattttaacatttagttttcctttactttatatagatgtgctttgtaaactcaggaaaagaaagagcccaaaagcccctaaatgacccaatctttaaatgcttgccaatattattggcagcttaattctcacagtaaagagactttctcatagcaaaacacaacatagttcctgccaatctatttttaatagctattttcgttaatattagtcaaacatggcacagagaatttaaatgtttaaaacaatccaaagggtgaaaaacacacaaactcatgaggataaactggaattgagtgtagaatacgagaaccagcccgtatagataagaatcccgtgcaaagagtgtaaaagaaaaacaaaacaacccttcagaaaagtcatcttctgataacttattctgtgactgtctttatatttgtcattttccccaaaactgaaaaaaagtagctttacaatgtcaaagatattttgcataagtaaacaacaagtgaaggaagtggctgtgtacttaaataagtcaaaaaataaagtattatctgtggaactcaaggtcaattttagacttaccatggtcaatcatactgacatagcaggtgacataaaacaatgagacagagtctaaaactcatacaccaaagcagtgcttaattttggagactcatttcaatacttgaaagaattgcaagcattaaagtggtttttaaaggtattaagtgacaggatgcagtgtttgtgaagtcttcagctatctggaatgatctgtagtgtttttcccaaaagtacactgaataaaatcagccagagtctaaaaataaaagttttgcttgagggtattctgcccatgcatgacacttttacaagtggcaagattcctggatgaattgttaactaatcaaatcttggcattttcaattaatgtagttattgagcctcaaggtaatacataactaaacttgtatattgaaggaataagatggagaagtacacagagtcttagatcaatatctttgcttacgaagtccagaatttacttacataggaactgatattgagttaaggggtcacaagatgttggtattcaagttttctggcatcttcctctctttacaagaaaaatagcttcactctggtattttcttaaagacatcatatgccaagataaaataatccattttttcataaacacattgggtgatttattaggttgaattacgtatggccctataatagtatttaaaaatatttaaaatattaaaaagcagagccaatcagttaaaatgatcaaaacccacaagataaatatttggaatatatattcatctctcatctatatagggaatggctttgggtatcattaagaatttttaaaaaaaatacagcagtgaaatagtactcaacaattgaacaacttcgtattcaaactcaacagtttttatttctgccagcttaagtagctagtgaaactggaaaactgcagcatctttgattatttgggtcactccatctttgtgaaattatcctagtaattccactggagatttcaatactttctgggacccattaaacttttcttgaccaaaagtcttcagaaatttctttacctgcagtccctagttgatttgatagatgacatctaaacagcctatgaaatgttaactttgatttttttttctattataacagctttatcttttaactttctggtgatgcagaaacgagtaacacgacacatcagacagaaattgaacatcacctagtggtatcagttcaattcaggtagttaaagaatccagatgttgtcacctggtactgtcaaacgactctaagcatgtacttaagtttcatttccatagcatctgcggcactttgaagttccactccttgtgctctcctcccactctcaaactagtgtgccaattcaagttcttgaagaccagggaaaattatgtttcttctgccgtggagattgatgctagtcatcttaagtcgtctggggaagaggctcagaaatgtgtgcatcttgtgtcttccacttttattttcccaacccgttacgaagttttggaagatatcttggtcccaaaaacactgacttgacactgtgctattcctctcaagaatctcattaactcccattagaaaggggagtggtgtggactccgtctcgtggtgaaactctctgcaaccccctaacataaatactagagatggggatggttagagggtcaaaggagggggacggaaaagggtcgtgagaagagactcaccgctgctgccagttcctcggtcaggcacaacgtaaccaggagcagccacaacctgaaatgggagggagggtgagtaatgggctctctaggcttcggggtcgtgcgtctgcctgtcgccccccgaacccttttggatgcctgctcccaatttctctgcagtgacagaagtaccagtatagtcccggcctggcaaagtaacccgaagtaagaaagaggaggggagctcggggcagcaacagctcacccagggtgcatgcttgcggctcctccggagctgggtcccgggagactgctaagcggctccgcggcccgtgctcatctgggctctgctgatgcttggaggctgtttccttactcagaacagagtaggtggacgaagtggcccagtttggaagaaactaaacactgcttctagataagaagtgctccaaagggaaacaggctcagcggtgcccgttacaacttgcagcactcaggagatagttccatgcagcaggagaggaaagaatggaggggaaaggggcggggctgtctgctgtcaatcatcccccctaccttgggcagccggtagtctttctcactttcaggcacctttccacacaacagccctaagtatctccacagcttcacacacagccccttagagacctatacgctaagacctaagcaactgtgcatcatatactttcaactttactgttaggttacacataaagagacataggcatactattcccacataagacagatgggcccgaaagtgcccttgcacacatgcccaaatgcatacaacactgattcaaattgatagtacactaggctattgggaaggggagacagtttctggagttgtaaatccactctgagctaagcagaacctaaggatgagtgggccctcgtgaaatagatccaaaaccttgaaagactctaaagtggttaattctaggaagatagaaatgttgtgaagaattcttcatcaaattcttgaagattctccaaggagtccgcagaaagtattttctagttcttttgttactttaaaaaaaatctatatatcagaattatcaaaggaacattcaagtctttatatgggagatatcgattcagctgccatcaactctatttaaatatttccaattaagtgtttatattaattctaagaaacactgcactaaatttatttaattccctgccctaaatctttctgaaacacaactacaatgagagtcaataccttttacattagctcaatataggaggcattaattataggattcaatgcagctaaacagagatatagctgtattataataacataataccatagaataattaccaatacctgctgaatgctcccagatcttatacgtatataacacacataaagtattcacgcacatatacttattttcttacttgtttataagcatatactttatttattcccaatattttcacatcttctgcttgtatgtagaaactctctgttctgtgagcagctggaaggtaaagaagaccagcagcccagggagcaccgaccaaaatttgtttctaatgagtaacaataaaaagcacggcccctctgagatccatccgctaaaaaaatagtcccagtttagatctatttgtaattggctttggtacgcacaccaatgagattggaactgagcctagaaaagtagtatcaacggaaggtgcaaatgaacgaatagaaaagcttcccggttggactcatggtgctcagtcaactagtctggaagtttccctcccccaaataactgagcgtcactccctcgcaggttgccggtgcagtctaaaactgtggcggagtgatactcaaattcccttgtgctggtgaggaggggggccttgcacggggaagagagggaggaaagtagatctgtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctcaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaattgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccttacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaagggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtaatagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttaacattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagcttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcaagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaattttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaataaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccaataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggatggtctgttgtgtatctcttcagcctgtgtggaaaaaacccctgctcatttacagatagattaccaatctgcacatcaacaagtcatctcttcccagggaatcagtttctccacgctttgatcactctgttagtagatagaaaacatatagtaatgtaaactttttccaatgaagaaaactacctattggaagacatttccaagataataaatttcttgacaacattgtgttaatggctaagaaaggaaacaactggcttctatttggggaagaattcattaataatgtttaaagcaggttagtgacctaatattcttaatgattaagaatgaacacgcatagttctctaaaatagtcaaggactggttaaaaataaaatattaaaaacttccatagtaaaatttgtgttacagctaaaagataaaacaaccaaaacaattttgagtattctaaatcctaatatggacctatgtaaaatctaaagcttagaatctctggtggtaaaacttaggatccaaacaatgataactatctaattattttattgattctggatagccaccaatcgcaaattttagctctattttttcatttagtcccatgcataaagtcagtaatgagtaattgtaactgaaaacaccatatcacagccccacagattcttctacatggtgtacactcaaaggtgccccttctgttatagtcgcaaacactaattccagagattttgctttttgtagctttccctctcatttatagctggttgaaagccttggcccaaaaagaacctcctttgtttgtttgtttgttttgttttgttttgttttgttttgttttgttttgagacagtctcctctgtcacccaggctggagtgcaatggcgtgatctcggctcactgcaacatccacctcctgggttcaaggcgattctcccacctcagcctccagactagctggaactacaggtgcataccaccacgcccggctaattttttgtatttttagtagagacggggtttcaccatgttgcccaggctggtcttgaactcctgaactcaagcgatctgcctgcctcggcctcccagagtgctgagattacaggcgtgagacaccacgcccatcccagaacctcctaatttttaaattgttgcatgtgcagctagtctatgtgtttcttaaatctcctaactattcctagccctgctttgttgtttgaagtacacaaattcattccaggacattaatattgttaaccctctcttgccatgaattattcaaagattaatctagctgctctactagttacctatggtgagttttttgtgttttgttttgttttgtttttgtttttgtttttttttgcttttttatcatctgtgaaatttccagaagtactatggtaagttttacagtcatacacaattaatagctttctcacattggcaggaaatgaatgaactattctgcttaatcagatagtttgactaccaaatatttatgtgtaccaaatgtggttttaccagttaatgaatctttcgtgattcagatgttacttaaggaccaaatcctagtattttatagctgtgtatgtgtgtgtgtgtgtgtgtgtgtgtgtgtgtgtgtgtgtgtgtacccacacacacgtgcacatgtatcttcagaaaaattgaggtctacatgaataacttccattatatatatattacgtaatatatatatacacacacacacatatggataagtgtatacacacacatgtgttgtgtaagaaagtagacattccaattatttttatagcttattggcctgatctttgctatgttggtgtcacactcattgcttccaaaggaggttgtattggacaccttgtgattgtatgatgttttttcccacccatccaaatttgaacaacactttttcattcttgtagtggcaataaggttctttgcctcaatgtcatgccaagccatcaaatgcttattcagaagttaatcacaagagggcactattgcctataaaaatgaatcagcatgtgtaatgatttgagctcattggtggtggtggtagggttgtctaaagtcctgtctctagattccctgttttaagtttcatttattctttcagcctcataaaaatcattagcaagtacttgaagaggtggcctagtttcccaatgtctgcatccaaaacgaagagaacagctttgctgtcaaagattctcttttgtttttttgtttgtttgtttttgagacggagttttgctcttgttgcccaggctggagtacaatggcacgatctcggctcactgcaacctctgcctcctgggttcagcgattctcctgcctcagcctccagagtagctgggattacaggcatgtgccaccacacctggctaattttgtatttttagtagagacggggtttcttcatgttggttagattctcttcttaagagcctgattaacagttggttctggtagcacttcccatgcctctcaacacagaagcaaggagcaatcacttttgtttggccggaacttcagttggtttccttggcagagaaactcagttctcaggctggactatacaaacaccttcatccctaggcagctccaaaataaattgaataatattttaaaatcatgtcatttccattttagagcagtggttttagagtatattcagggagcttggaaagtttgtttggtggaaatactcctaagttggaattgaatccagagaggcctgtctcctgagttctatatcaacaaatattgattggatgcttgttagctaaggacaccatgaaggatagcaatctaaaatgaactcaacctcaaccaggagaataagcagtgaccataatatagtaaatcctcacttcacgtggtcaatatatttttagaagctgtgactttaaaggaaacgatgtccaatattattcagttataatgttgatgaagaaaaaatggatttgttatatgtcgtttagctttaaagtcaaagtttccaagaacctatggacgttaactgaggacttactgtatgtatactggaaaagaggtatgctagtctgtctttgactaccaaatcttactaattctaggccagataatggggatttttgtaagagtagctgtctggaggaagctggctcaccaacctgttccccaaaacatgggctaaaatcacatttatgtaatcttaatcatctatttctctgttagtggactgcatacccaacacctgaccctacaggataacaaattgcttacataataccaatttatgccaaatatcttctgtttccccctctaccatcacatttcatcctgctttctgccccagagggttcctgagccctctggcttctgattgggttcaaccagttggaagtcccagcagaataccagaggaggggacaagagttgggttagggtatttattttcatggctctttctctatgaggttacctcaggttggtttgtgactctcaattgaatgtccctactgctctcaagatgacttactattcctaattatcttcctttctggttctactaaccccttctcatgttttcaggtctaggtgtgatgggtatggtgacaagtctgctgttgctgtgctgctagacctggattcctgaacaaccatttgtgattccccctccacaccatctatatatttctaattaaactctcctcagattatcctaatttaagtgtgttgtacttttgttgttgatactccaacgaatactcaacacttctagtttccaaaatctagagaaagtgctttatttccatatgtgacaaaatgagggtgaattgataaaactgacatgcatgattaagcatgcatctttgactttgaactaagggatgggccagcagaaatatgacttaacaccacttaatctaagacctagtttatcaagagttattggaagctgtgttccagggtacttatggtgaaatgaggcaaaatatgttccttatgatcctaaattatttatctttttccaattagtgtcccactggatctctaaagaatgcacttttatttcccccaggtagtcatttgtcttcctacatcttaacttcaaataattaatttgttaactcattagcagactagattacaagtaccaataactcatctctgaaagctccaaagagaaactcccggtagtattacttcaaccagaggaatctgctaagccagatatacctgcttgcagtcagtgaaaagccctgaagtgttactagctgagaaatgagtaatttattagtggttttctagcctcaagagcatctgtaaaagtaagcctgcagaagttcttcacatctgcttcccttctgttcaagggtaccagagtgaatgcttatactagggattatggaagacaggtcatgttctaaagccaaagacagcctgagaatactgtacttggtaatttcaaccagtcccacaccgaacctaccaagaagccaacatactctctcttcaagcaaaatagtttcctggttgattttcatagggccagcaaagtgcttgctgttgccagtctatcataagctacaatggtaacccccgatgtcagatccttgtgtctctctgacacaataatttgacctttgcttgggctgcaaggaaggctacctctaacacctcagtagtaataagactaacaccttatatgtatgtagttcttattaaaatatcatcctttacacatttcatctgagtctcaacaactctgatgtactcaagcagtgcaaggattagtctccaatatacagatgtggaagctgagccttggaatggttaactgaccccaaaagtcacaagttactaagttcttttcactccaaatctaatcgtcacttttgagccatgaagatgcctatatctaaaatcttataatcctgtgtggtagacattcatagcaatatatatagaggtctctgcctcatgagaagtgataggctgtatgttttggaagtcttggttcccaggtaaggatgaatgctttcctagcacctttgcagcacctgaaaccccttggaattaacctttaggcacagggggcttatagttaatccattgtacctcaggatactctgtctggtctaagcctctatagctaaagaaaactttatgggtgtggcctggtgccctcatgtgaacttcctcagggcttttgaatccagatgaactcctggaatttaaatgccctggcctgcagcctcgtcaatgctattagtgtctaaggaagggccagttttgtaaatctgagaccatcctactaattttattatctattatagacaatgcagaaaggactccatggaggggaaaatttctttagctccaacagtaaagttcgttatattttgtttacacttaatatacataaacttatagaagcaatttgagtttgctagctgtaacctccattggtcacattttacatgcagaagtttcccttatttgactccctttagcggaaatttacactaggaatcatatgagcaaacataaagccagctgggccaagcagtatgtggctatttatcagattagagaggcaggaaaggttaaagacaagttagagaacatgtgggctaaaatagggctctgcatagcttattgtaatcagaaataagcctggctttgaggttactgggtttaagtatgttattaagttgactatgtactttcagatgtggaaattgttgcccaccttaaggccagcaacagcacagaaaactactccccatggagtgtaaagtgataacaacctgaagccatttttacaaacacttccttctcctactcagaaagcagcattttcttttattctctgagcaggcagaagcacccatgggtgcatgaaagtgtgctagtgcttttcttcttgcagctctgtttttccttcatctattttgaaaatttgcttttaggtgcataaatatttatgattgttatatccccttgataaaatgatctctttattattattataatggtaatatagtaaagaaaatgttaatattatttgctctgaaaactacattgatagcaatattgccatccagctttccttgtgttagtgttaacatattttttcattattttacttttaacctagttctgtctttctatttgaagcgcatttcctgagggtcacatagttggatcctactttttaatacaatatgacaatttttactttttaatggactgcacttaatgtgcttattgatatggttaagttcaactctgttatcttatttgttttctatttgcctcattcgtaatgtgttcactttttatgctttgttttggattaattgaatattttttctgattcccttttatctcctttgtggatattaactgtaacattttgtttggttaatttagtggctgctttagtttttatggcacacatttttaacttatcacagtctatattcaagtcacataataccacttcatgtatgctataagaatgttacaatagtatactttcaattctcccctcttgatcttcgcaccactattttcatacactatgtttattatgttataaataccacactacattgctgttatttttgtttaaacagtatattctcttttatattagacataattcatatacaataaaattcaccctgttaaagggtacagtgtaatggtttctagtatattcacaaaatttttcaaccatcaatcctgtctaattccagaacattttcatcaccctgaaaataatcccatgcaatcagaccccattttcctcatcccttcctcctctcagccctacgaaaccaccagtctgttttctgtctctatagatttgcctattctggacatttcgtataaatggaatcatacaacatatatgggcttttgtgtctggcttctttaacaaggatcatccatgttgttgcatgtgctggtacttcatttctttattttttaaattcaagtgaaatccaagtaacttaaaactaaccattttaaagcaaacaattcgagtgccatttagtacatccacagtgtgcagtgtggtgcaaccacctccttaatctagctacaaaacagcctcatcactccaaaagaaaaccccgtatccattaaggagtcactctccagtccccacagccactggcaggcactaatctactttctgtctctatagatttacctattctgaatgttttatataaatggaatcttacaatatgtgacttttttgggtctgctttttttttcatttagcataatgttttcaaggttcatccatgttacagcatgtatgagtacttcattctttttatgttgcataataatacatcgtaaggttataccacatttgtttgtccattcatccattgacaaatatgttgtttccaccttttggtgaatttgaatagcgctgctatgaacattcatggacaaatatttgtttgaatacctgttttcaagtctttcaggtatgcctaggagtgaatttgctgagtcatatagtaattctgtttaacttcttgaggaagttaagccaaactgttttctactggaccaacaccatttcacattcccaccagctgtgtgcaaaagtccaatttttccacatctttacaaaaatatgttatttttccatttttaattattgccatcccagtgagtgtaaagtggtatctcattgtggtggtttttggtggtggtggtgttgtttttatttagacaaggctctgtcacccaggctggagggcagtggcagaatgatacctcactgcagcctcaaaacctggactcaaggaatcctcctgcctcagcctcctgagtagctgggactaaaggcacatgccatcatgtctggctaatttatttttatttattttttgtagatatggggtgttgatttgttgccgaggctggtctcaaattcctgggctcaagctatcctcctgctttggcctcctaaagtactggaattacaggcatggtgccactgcacaggtctcattgtagttttgatttgcatttccctactgactaatgattctgagagtcttatgtgcttgttggccgtttgtgtatcttctttagagaaatgtcaatgtaaatgctttgcccattttcaattgggttatttgtcttttcactggtgagttgtaagagtactttatatattatagatacctatcctttatcagatatatgatttctgaatattttctctcattctgagggttatctttttactttcttgatggtgtcttttaaagcacaggatattttagttttaacgaaatatcaaaaatattttccttttgttacttttgcttttggtgtcacatgtaagaaatcattgcctaatccaagtgcacaatgtttaactcctatgttttggctcatacatttaagtctttaatctatattgagttaatttttaaacatagtgtgaagtaagatttcaaatttattattctgcatgcagttgtcccagcaccatttgttgaaaagactttttctttcctctattaaattgtcttgatacacttgtcaaaaacggatccaccacagaagtatggctttatttctggattctctgtgccatagatcgatatgtctgtgtttatgccagtactacacagtctatttttttttaagatagggtctaactctgtcacccagtttgcaatgcagtgacatgaacatggctcactgtagcctctacctacagggtccaagtgatcctccttactcagcttcctgtgtagctgagagcatgggtggtgccaccatgcctggctaagtttttgtagaggtggtatctcactttgttccccaggctggtctcaaacttctgggctcaagcaattctcctgcccccgcctcccagaaggctgggattacaggcatgagccactgtgcctggcctcacagtcttgattacagtaacattgcagtaagttttgaaatagtcaagtgccagtctttcaacattgttctttttcaagattgttttggctattcaggctcccttgcaattccatatgcatttagtctcagcttgtcaattgctgccaaaaaataaaagaagaagaagacaactgggatattaatagattacattgaatctgtacatcactttggggagtatcgtattttaacagtattaagtcttctgacccatgaacaaacactctttttctatttatgtagatcttccttaatttctttcaataatgttttgtagttattggtgtacaagtcttgcacttttattcctaagtattttattcttttgtgttactataaatggaatttctctattaatttccttttcatatttctcattgctagtgtatagaaatacaatttttgtttttggttgtatattgatcttgtatcctgcaactttgcctaatgcatttgttagctataatagttttttagtggatttatcaggatgttgtatatataacgtcatgtcttctgcaaattgacatagctttccttctttctttccagtccttatgctttttattttgtcttccttgtctaattgattaggctagaaacttcagtacaatattaaatagaagcaatgagaataaacatctttttcttggccccattctacggaggaaggttttagtctttcaccattaagtatgatgttagcagtagattttcatagataccttttctcagtttgagacagttcccttgtattcctagttgttgagtgcagtgtttttatcatgaaaatatgttggatattgtcaaatgctttttctgcaccaattgagatcattgtgtgagttttatccttcattttattaactaggtgtatgacattgattaatttaaatatgttgaaccagtcttgctttcctagtataaatcccacttggtcatggtgtataatatttttaatacgctgttgaatttggtttgctagtattttgttgagt

SEQ ID NO: 84 - DNA, 5278 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgattattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataa

SEQ ID NO: 85 - protein, 1266 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMQFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGMSDY

SEQ ID NO: 86 - DNA, 6437 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggattattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 87 - protein, 1281 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMQFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLLRSTRSRRSSRSPWKWRY

SEQ ID NO: 88 - DNA, 6423 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 89 - protein, 1679 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMQFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPQGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQASPGSCLEEFRSAPFIECHGRGTCNYYANSYSFWLATVDVSDMFSKPQSETLKAGDLRTRISRCQVCMKRT

(The sequence listing continues in the following parts.)

The invention claimed is:

1. A method for diagnosing colon, stomach or prostate cancer comprising: a) determining the expression level of a nucleic acid consisting of the entire nucleotide sequence of SEQ ID NO: 69, or consisting of a full complement thereof, in a sample comprising a first tissue type of a first individual; and b) comparing said level of said nucleic acid in (a) to: (1) the level of the nucleic acid in a second sample, said second sample comprising a normal tissue type from said first individual, or (2) the level of the nucleic acid in a third sample, said third sample comprising a normal tissue type from a second unaffected individual; wherein an increase of at least 50% between the level of the nucleic acid in (a) and the level of the nucleic acid in the second sample or the third sample indicates that the first individual has cancer.

2. The method of claim 1, wherein the difference between the level of the nucleic acid in (a) and the level of the nucleic acid in the second or the third sample is at least 100%.

3. The method of claim 1, wherein the difference between the level of the nucleic acid in (a) and the level of the nucleic acid in the second or the third sample is at least 150%.

4. A method for diagnosing colon, stomach or prostate cancer comprising comparing a level of cytokine receptor 2 A mRNA in a patient sample comprising colon, breast or prostate tissue to the level of the cytokine receptor 2 A mRNA in a normal control, wherein the cytokine receptor 2 A mRNA consists of the nucleotide sequence of SEQ ID NO:69; wherein an increase of at least 50% from the level in the patient sample relative to the normal control indicates that the patient has or is predisposed to colon, stomach or prostate cancer.

5. The method of claim 4 wherein an increase of at least 100% from the level of the cytokine receptor 2 A mRNA in the patient sample relative to the normal control indicates that the patient has or is predisposed to colon, stomach or prostate cancer.

6. A method for diagnosing colon, stomach or prostate cancer comprising detecting differential expression of the expression product of the nucleotide sequence set forth in SEQ ID NO:69 in a patient sample, wherein evidence of differential expression of the expression product indicates that the patient has colon, stomach or prostate cancer.

7. The method of claim 6 wherein differential expression is detected by measuring the level of the expression product.

8. The method of claim 7 wherein the level of the expression product in the patient sample is compared to a control.

9. The method of claim 8 wherein the control comprises normal colon, stomach or prostate tissue.

10. The method of claim 8 wherein the level of the expression product in the patient sample is increased at least 200% relative to the control.

* * * * *